(12) United States Patent
Dombrowski et al.

(10) Patent No.: US 11,697,806 B2
(45) Date of Patent: Jul. 11, 2023

(54) POLYNUCLEOTIDES, COMPOSITIONS, AND METHODS FOR GENOME EDITING

(71) Applicant: Intellia Therapeutics, Inc., Cambridge, MA (US)

(72) Inventors: Christian Dombrowski, Auburndale, MA (US); Jonathan Douglas Finn, Melrose, MA (US); Amy Madison Rhoden Smith, Durham, NC (US); Seth C. Alexander, Medford, MA (US)

(73) Assignee: Intellia Therapeutics, Inc., Cambridge, MA (US)

( * ) Notice: Subject to any disclaimer, the term of this patent is extended or adjusted under 35 U.S.C. 154(b) by 461 days.

(21) Appl. No.: 16/828,615

(22) Filed: Mar. 24, 2020

(65) Prior Publication Data

US 2020/0354702 A1    Nov. 12, 2020

Related U.S. Application Data

(63) Continuation of application No. PCT/US2018/053439, filed on Sep. 28, 2018.

(60) Provisional application No. 62/566,144, filed on Sep. 29, 2017.

(51) Int. Cl.
| | | |
|---|---|---|
| *C12N 15/11* | (2006.01) | |
| *C12N 9/22* | (2006.01) | |
| *A61K 9/51* | (2006.01) | |
| *C12N 15/88* | (2006.01) | |
| *C12N 15/85* | (2006.01) | |

(52) U.S. Cl.
CPC .............. *C12N 9/22* (2013.01); *A61K 9/5123* (2013.01); *C12N 15/11* (2013.01); *C12N 15/111* (2013.01); *C12N 15/85* (2013.01); *C12N 15/88* (2013.01); *C12N 2310/20* (2017.05); *C12N 2320/32* (2013.01); *C12N 2800/80* (2013.01)

(58) Field of Classification Search
None
See application file for complete search history.

(56) References Cited

U.S. PATENT DOCUMENTS

| | | |
|---|---|---|
| 5,378,825 A | 1/1995 | Cook et al. |
| 5,585,481 A | 12/1996 | Arnold, Jr. et al. |
| 8,889,356 B2 | 11/2014 | Zhang |
| 9,023,649 B2 | 5/2015 | Mali et al. |
| 2014/0186958 A1 | 7/2014 | Zhang |
| 2015/0166980 A1 | 6/2015 | Liu et al. |
| 2016/0304846 A1 | 10/2016 | Liu et al. |
| 2016/0312198 A1 | 10/2016 | Joung et al. |
| 2016/0312199 A1 | 10/2016 | Joung et al. |

FOREIGN PATENT DOCUMENTS

| | | |
|---|---|---|
| WO | 1993013121 A1 | 7/1993 |
| WO | 1995032305 A1 | 11/1995 |
| WO | 2006007712 | 1/2006 |
| WO | 2013176772 A1 | 11/2013 |
| WO | 2014065596 A1 | 5/2014 |
| WO | 2014136086 | 9/2014 |
| WO | 2014204725 A1 | 12/2014 |
| WO | 2015006747 A2 | 1/2015 |
| WO | 2015089406 | 6/2015 |
| WO | 2015095340 | 6/2015 |
| WO | 2016010840 A1 | 1/2016 |
| WO | 2016077123 A1 | 5/2016 |
| WO | 2016106121 A1 | 6/2016 |
| WO | 2017036889 A1 | 3/2017 |
| WO | 2017053297 | 3/2017 |
| WO | 2017127750 A1 | 7/2017 |
| WO | 2017173054 | 10/2017 |

OTHER PUBLICATIONS

Benson et al. (2006) "GenBank" Nucleic Acids Res. 34(Database issue), D16-20.
Cong, L. et al.: "Multiplex Genome Engineering Using CRISPR/Cas Systems", Science, vol. 339, No. 6121, Feb. 14, 2013 (Feb. 14, 2013), pp. 819-823.
Dittmar KA, "Tissue-specific differences in human transfer RNA expression" PLos Genetics 2(12): e221 (2006).
Gilbert et al., "CRISPR-mediated modular RNA-guided regulation of transcription in eukaryotes," Cell 154:442-51 (2013).
Guo, P. and Moss, B. (1990) "Interaction and mutual stabilization of the two subunits of vaccinia virus mRNA capping enzyme coexpressed in *Escherichia coli*" Proc. Natl. Acad Sci. USA 87, 4023-4027.
Ishikawa et al., "Preparation of eukaryotic mRNA having differently methylated adenosine at the 5'-terminus and the affect of the methyl group in translation" Nucl. Acids. Symp. Ser. (2009) No. 53, 129-130.
Kariko, et al. "Generating the optimal mRNA for therapy: HPLC purification eliminates immune activation and improves translation of nucleoside-modified, protein-encoding mRNA" Nucleic Acids Research, 2011, vol. 39, No. 21 e142.
Katibah et al. (2014) "Broad and adaptable RNA structure recognition by the human interferon-induced tetratricopeptide repeat protein IFIT5" Proc Natl Acad Sci USA 111(33):12025-30.
Kosugi et al. (2009) "Six classes of nuclear localization signals specific to different binding grooves of importin alpha" Journal of Biological Chemistry, 284(1), 478-485.
Maier, M.A., et al. "Biodegradable Lipids Enabling Rapidly Eliminated Lipid Nanoparticles for Systemic Delivery of RNAi Therapeutics" Mol Ther. 2013, 21(8), 1570-78.
Makarova et al., "An updated evolutionary classification of CRISPR-Cas systems" Nat Rev Microbiol, 13(11): 722-36 (2015).
Makarova et al., "Evolution and classification of the CRISPR-Cas systems" Nat. Rev. Microbiol. 9:467-477 (2011).
Mali et al., "CAS9 transcriptional activators for target specificity screening and paired nickases for cooperative genome engineering," Nat. Biotechnol. 31:833-8 (2013).

(Continued)

*Primary Examiner* — Ekaterina Poliakova-Georgantas
(74) *Attorney, Agent, or Firm* — McNeill Baur PLLC

(57) ABSTRACT

Compositions and methods for gene editing. In some embodiments, a polynucleotide encoding Cas9 is provided that can provide one or more of improved editing efficiency, reduced immunogenicity, or other benefits.

26 Claims, 51 Drawing Sheets

Specification includes a Sequence Listing.

(56) References Cited

OTHER PUBLICATIONS

Mali, P., et al.: "RNA Guided Human Genome Engineering via Cas9", Science, vol. 339, No. 6121, Jan. 3, 2013 (Jan. 3, 2013), pp. 823-826.

Mao, X. and Shuman, S. (1994) "Intrinsic RNA (guanine-7) methyltransferase activity of the vaccinia virus capping enzyme D1 subunit is stimulated by the D12 subunit. Identification of amino acid residues in the D1 protein required for subunit association and methyl group transfer" J. Biol. Chem. 269, 24472-24479.

Mefferd et al., "Expression of CRISPR/Cas single guide RNAs using small tRNA promoters" RNA. 2015 21:1683-9.

Nakamura et al. (2000) "Codon usage tabulated from international DNA sequence databases: status for the year 2000" Nucl. Acids Res. 28, 292.

Perez-Pinera et al., "RNA-guided gene activation by CRISPR-Cas9-based transcription factors," Nat. Methods 10:973-6 (2013).

Qi et al., "Repurposing CRISPR as an RNA-guided platform for sequence-specific control of gene expression," Cell 152:1173-83 (2013).

Rejman et al., "Characterization and transfection properties of lipoplexes stabilized with novel exchangeable polyethylene glycol-lipid conjugates" Biochimica et Biophysica Acta 1660 (2004) 41-52.

Romberg et al., "Sheddable coatings for long-circulating nanoparticles" Pharmaceutical Research, vol. 25, No. 1, 2007, p. 55-71.

Scherer et al., "Optimization and characterization of tRNA-shRNA expression constructs" Nucleic Acids Res. 2007 35: 2620-2628.

Shmakov et al., "Discovery and Functional Characterization of Diverse Class 2 CRISPR-Cas Systems" Molecular Cell, 30:385-397 (2015).

Stepinski et al., (2001) "Synthesis and properties of mRNAs containing the novel 'anti-reverse' cap analogs 7-methyl (3'-O-methyl)GpppG and 7-methyl(3'deoxy)GpppG," RNA 7: 1486-1495.

Szymczak, D.: "Optimizing the CAS9 messenger RNA for vector-free gene editing", tebu-bio's blog, Jun. 28, 2017 (Jun. 28, 2017).

The Biochemistry of the Nucleic Acids, Adams et al., ed., 11th ed., 1992, pp. 1 (Abstract).

Thess, A. et al.: "Sequence-engineered mRNA Without Chemical Nucleoside Modifications Enables an Effective Protein Therapy in Large Animals", Molecular Therapy : The Journal of the American Society of Gene Therapy, vol. 23, No. 9, Jun. 8, 2015 (Jun. 8, 2015), pp. 1456-1464.

Vaidyanathan, S. et al: "Maximizing Translation of Cas9 mRNA Therapeutics by Sequence Engineering and Chemical Modification", 20th ASCGT Annual Meeting, May 2017, May 13, 2017 (May 13, 2017).

Vaidyanathan, S. et al: "Uridine Depletion and Chemical Modification Increase Cas9 mRNA Activity and Reduce mmunogenicity without HPLC Purification", Molecular Therapy—Nucleic Acids, vol. 12, Jun. 30, 2018 (Jun. 30, 2018), pp. 530-542.

Vester and Wengel, 2004, "LNA (locked nucleic acid): high-affinity targeting of complementary RNA and DNA" Biochemistry 43(42):13233-41.

Zetsche et al. (2015) "Cpf1 is a single RNA-guided endonuclease of a class 2 CRISPR-Cas system" Cell Oct. 22:163 (3): 759-771.

POLYNUCLEOTIDES, COMPOSITIONS, AND METHODS FOR GENOME EDITING

This application is a Continuation of International Application No. PCT/US2018/053439, which was filed on Sep. 28, 2018, which claims the benefit of priority to U.S. Provisional Application No. 62/566,144, which was filed on Sep. 29, 2017, the contents of each of which are incorporated by reference in their entirety.

The instant application contains a Sequence Listing which has been submitted electronically in ASCII format and is hereby incorporated by reference in its entirety. Said ASCII copy, created on Mar. 23, 2020, is named 2020-03-23_01155-0020-00US_ST25.txt and is 963,262 bytes in size.

The present disclosure relates to polynucleotides, compositions, and methods for genome editing involving RNA-guided DNA binding agents such as CRISPR-Cas systems and subunits thereof.

RNA-guided DNA binding agents such as CRISPR-Cas systems can be used for targeted genome editing, including in eukaryotic cells and in vivo. Such editing has been shown to be capable of inactivating certain deleterious alleles or correcting certain deleterious point mutations. The agent can be expressed in situ by providing mRNA encoding it. Existing approaches may, however, provide less editing efficiency than desired or may be undesirably immunogenic, e.g., may provoke an undesirable elevation in cytokine levels.

Thus, there is a need for improved polynucleotides, compositions, and methods for genome editing. The present disclosure aims to provide compositions and methods for genome editing that provide one or more benefits such as at least one of improved editing efficiency or reduced immunogenicity (e.g., reduced elevation in cytokines upon administration), or at least to provide the public with a useful choice. In some embodiments, a polynucleotide encoding an RNA-guided DNA binding agent is provided, wherein one or more of its codon usage, non-coding sequence (e.g., a UTR), heterologous domain (e.g., NLS), and/or nucleotide content differs from existing polynucleotides in a manner disclosed herein. It has been found that such features can provide benefits such as those described above. In some embodiments, the improved editing efficiency occurs in or is specific to an organ or cell type of a mammal, such as the liver or hepatocytes.

SUMMARY

Embodiment 1 is an mRNA comprising an open reading frame encoding an RNA-guided DNA-binding agent, wherein the open reading frame has a uridine content ranging from its minimum uridine content to 150% of the minimum uridine content.

Embodiment 2 is an mRNA comprising an open reading frame encoding an RNA-guided DNA-binding agent, wherein the open reading frame has a uridine dinucleotide content ranging from its minimum uridine dinucleotide content to 150% of the minimum uridine dinucleotide content.

Embodiment 3 is an mRNA comprising an open reading frame encoding an RNA-guided DNA-binding agent, wherein the open reading frame has an adenine content ranging from its minimum uridine content to 150% of the minimum adenine content.

Embodiment 4 is an mRNA comprising an open reading frame encoding an RNA-guided DNA-binding agent, wherein the open reading frame has an adenine dinucleotide content ranging from its minimum adenine dinucleotide content to 150% of the minimum adenine dinucleotide content.

Embodiment 5 is an mRNA comprising a sequence with at least 90% identity to any one of SEQ ID NO: 1, 4, 7, 9, 10, 11, 12, 14, 15, 17, 18, 20, 21, 23, 24, 26, 27, 29, 30, 50, 52, 54, 65, 66, or 107-175, wherein the mRNA comprises an open reading frame encoding an RNA-guided DNA-binding agent.

Embodiment 6 is an mRNA comprising an open reading frame encoding an RNA-guided DNA-binding agent, wherein the open reading frame has at least 90% identity to any one of SEQ ID NO: 1, 4, 7, 9, 10, 11, 12, 14, 15, 17, 18, 20, 21, 23, 24, 26, 27, 29, 30, 50, 52, 54, 65, 66, or 107-175 over at least its first 30, 50, 70, 100, 150, 200, 250, or 300 nucleotides.

Embodiment 7 is the mRNA of any one of the preceding embodiments, wherein the open reading frame consists of a set of codons of which at least 75% of the codons are (i) codons listed in Table 1, Table 2, or Table 3, or (ii) a set of codons listed in Table 4.

Embodiment 8 is an mRNA encoding an RNA-guided DNA-binding agent comprising an open reading frame encoding an RNA-guided DNA-binding agent, wherein the open reading frame consists of a set of codons of which at least 75% of the codons are codons listed in Table 1, Table 2, Table 3, or (ii) a set of codons listed in Table 4.

Embodiment 9 is the mRNA of embodiment 7 or 8, wherein the open reading frame consists of a set of codons of which at least 75% of the codons are codons of the low U 1 set in Table 4.

Embodiment 10 is the mRNA of embodiment 7 or 8, wherein the open reading frame consists of a set of codons of which at least 75% of the codons are codons of the low A set in Table 4.

Embodiment 11 is the mRNA of embodiment 7 or 8, wherein the open reading frame consists of a set of codons of which at least 75% of the codons are codons of the low A/U set in Table 4.

Embodiment 12 is the mRNA of embodiment 7 or 8, wherein the open reading frame consists of a set of codons of which at least 75% of the codons are codons of the long half life set in Table 4.

Embodiment 13 is the mRNA of any one of embodiments 7-12, wherein at least 80%, 85%, 90%, 95%, 98%, 99%, or 100% of the codons are (i) codons listed in Table 1, Table 2, or Table 3, or (ii) a set of codons listed in Table 4.

Embodiment 14 is the mRNA of any one of embodiments 1-5 or 7-13, wherein the open reading frame has at least 90% identity to any one of SEQ ID NO: 1, 4, 7, 9, 10, 11, 12, 14, 15, 17, 18, 20, 21, 23, 24, 26, 27, 29, 30, 50, 52, 54, 65, 66, or 107-175 over at least its first 30, 50, 70, 100, 150, 200, 250, or 300 nucleotides.

Embodiment 15 is the mRNA of any one of the preceding embodiments, wherein the open reading frame has at least 90% identity to any one of SEQ ID NO: 1, 4, 7, 9, 10, 11, 12, 14, 15, 17, 18, 20, 21, 23, 24, 26, 27, 29, 30, 50, 52, 54, 65, 66, or 107-175 over at least its first 10%, 12%, 15%, 20%, 25%, 30%, or 35% of its sequence.

Embodiment 16 is the mRNA of any one of embodiments 1-4, or 6-15, wherein the mRNA comprises a sequence with at least 90% identity to any one of SEQ ID NO: 1, 4, 7, 9, 10, 11, 12, 14, 15, 17, 18, 20, 21, 23, 24, 26, 27, 29, 30, 50, 52, 54, 65, or 107-175.

Embodiment 17 is the mRNA of any one of the preceding embodiments, wherein the open reading frame has a uridine dinucleotide content ranging from its minimum uridine dinucleotide content to 101%, 102%, 103%, 105%, 110%, 115%, 120%, 125%, 130%, 135%, 140%, 145%, or 150% of the minimum uridine dinucleotide content.

Embodiment 18 is the mRNA of any one of the preceding embodiments, wherein the open reading frame has a uridine content ranging from its minimum uridine content to 101%, 102%, 103%, 105%, 110%, 115%, 120%, 125%, 130%, 135%, 140%, 145%, or 150% of the minimum uridine content.

Embodiment 19 is the mRNA of any one of the preceding embodiments, wherein the open reading frame has an adenine content ranging from its minimum uridine content to 101%, 102%, 103%, 105%, 110%, 115%, 120%, 125%, 130%, 135%, 140%, 145%, or 150% of the minimum adenine content.

Embodiment 20 is the mRNA of any one of the preceding embodiments, wherein the open reading frame has an adenine dinucleotide content ranging from its minimum adenine dinucleotide content to 101%, 102%, 103%, 105%, 110%, 115%, 120%, 125%, 130%, 135%, 140%, 145%, or 150% of the minimum adenine dinucleotide content.

Embodiment 21 is the mRNA of any one of the preceding embodiments, which comprises a 5' UTR with at least 90% identity to any one of SEQ ID NOs: 32, 34, 36, 38, 41, or 75-77.

Embodiment 22 is the mRNA of any one of the preceding embodiments, which comprises a 3' UTR with at least 90% identity to any one of SEQ ID NOs: 33, 35, 37, 39, or 40.

Embodiment 23 is the mRNA of embodiment 21 or 22, wherein the mRNA comprises a 5' UTR and a 3' UTR, from the same source.

Embodiment 24 is the mRNA of any one of the preceding embodiments, which comprises a 5' cap selected from Cap0, Cap1, and Cap2.

Embodiment 25 is the mRNA of any one of the preceding embodiments, wherein the open reading frame has codons that increase translation of the mRNA in a mammal.

Embodiment 26 is the mRNA of embodiment 25, wherein the open reading frame has codons that increase translation of the mRNA in a specific organ of a mammal.

Embodiment 27 is the mRNA of embodiment 26, wherein the organ is liver.

Embodiment 28 is the mRNA of any one of embodiments 25 to 27, wherein the mammal is a human.

Embodiment 29 is the mRNA of any one of embodiments 25 to 28, wherein the codons increase translation of the mRNA in the mammal relative to translation of an mRNA comprising an ORF with a sequence consisting of SEQ ID NO: 5.

Embodiment 30 is the mRNA of any one of the preceding embodiments, wherein, when the mRNA is administered to a mammal in a pharmaceutical composition, the mammal exhibits a cytokine response at least 5 times lower than a mammal administered an mRNA comprising an ORF encoding a Cas9 nuclease with greater than 150% of the minimum uridine content.

Embodiment 31 is the mRNA of embodiment 30, wherein the mRNA comprising the ORF encoding the Cas9 nuclease with greater than 150% of the minimum uridine content has a sequence consisting of SEQ ID NO: 5.

Embodiment 32 is the mRNA of any one of the preceding embodiments, wherein the RNA-guided DNA-binding agent has double-stranded endonuclease activity.

Embodiment 33 is the mRNA of embodiment 32, wherein the RNA-guided DNA-binding agent comprises a Cas cleavase.

Embodiment 34 is the mRNA of any one of the preceding embodiments, wherein the RNA-guided DNA-binding agent has nickase activity.

Embodiment 35 is the mRNA of embodiment 34, wherein the RNA-guided DNA-binding agent comprises a Cas nickase.

Embodiment 36 is the mRNA of any one of embodiments 1-31, wherein the RNA-guided DNA-binding agent comprises a dCas DNA binding domain.

Embodiment 37 is the mRNA of any one of embodiments 33 or 35-36, wherein the Cas cleavase, Cas nickase, or dCas DNA binding domain is a Cas9 cleavase, Cas9 nickase, or dCas9 DNA binding domain.

Embodiment 38 is the mRNA of any one of the preceding embodiments, wherein the encoded RNA-guided DNA-binding agent comprises a nuclear localization signal (NLS).

Embodiment 39 is the mRNA of embodiment 38, wherein the NLS is linked to the C-terminus of the RNA-guided DNA-binding agent.

Embodiment 40 is the mRNA of embodiment 38, wherein the NLS is linked to the N-terminus of the RNA-guided DNA-binding agent.

Embodiment 41 is the mRNA of any one of embodiments 38-40, wherein the NLS comprises a sequence having at least 80%, 85%, 90%, or 95% identity to any one of SEQ ID NOs: 78-91.

Embodiment 42 is the mRNA of any one of embodiments 38-40, wherein the NLS comprises the sequence of any one of SEQ ID NOs: 78-91.

Embodiment 43 is the mRNA of any one of embodiments 38-42, wherein the NLS is encoded by a sequence having at least 80%, 85%, 90%, 95%, 98% or 100% identity to the sequence of any one of SEQ ID NOs: 92-104.

Embodiment 44 is the mRNA of any one of embodiments 37-43, wherein the mRNA comprises a sequence with at least 90% identity to SEQ ID NO: 4, 7, or 9.

Embodiment 45 is the mRNA of any one of embodiments 37-43, wherein the mRNA comprises a sequence with at least 95% identity to SEQ ID NO: 4, 7, or 9.

Embodiment 46 is the mRNA of any one of embodiments 37-43, wherein the mRNA comprises a sequence with at least 98% identity to SEQ ID NO: 4, 7, or 9.

Embodiment 47 is the mRNA of any one of embodiments 37-43, wherein the mRNA comprises a sequence 100% identical to SEQ ID NO: 4, 7, or 9.

Embodiment 48 is the mRNA of any one of embodiments 37-43, wherein the mRNA comprises a sequence with at least 90% identity to SEQ ID NO: 111, 114, or 117.

Embodiment 49 is the mRNA of any one of embodiments 37-43, wherein the mRNA comprises a sequence with at least 95% identity to SEQ ID NO: 111, 114, or 117.

Embodiment 50 is the mRNA of any one of embodiments 37-43, wherein the mRNA comprises a sequence with at least 98% identity to SEQ ID NO: 111, 114, or 117.

Embodiment 51 is the mRNA of any one of embodiments 37-43, wherein the mRNA comprises a sequence 100% identical to SEQ ID NO: 112, 122, or 125.

Embodiment 52 is the mRNA of any one of embodiments 37-43, wherein the mRNA comprises a sequence with at least 90% identity to SEQ ID NO: 112, 122, or 125.

Embodiment 53 is the mRNA of any one of embodiments 37-43, wherein the mRNA comprises a sequence with at least 95% identity to SEQ ID NO: 112, 122, or 125.

Embodiment 54 is the mRNA of any one of embodiments 37-43, wherein the mRNA comprises a sequence with at least 90% identity to SEQ ID NO: 10, 11, 12, 14, 15, 17, 18, 20, 21, 23, 24, 26, 27, 29, 30, 50, 52, 54, 65, 66, or 107-175.

Embodiment 55 is the mRNA of any one of embodiments 37-43, wherein the mRNA comprises a sequence with at least 95% identity to SEQ ID NO: 10, 11, 12, 14, 15, 17, 18, 20, 21, 23, 24, 26, 27, 29, 30, 50, 52, 54, 65, 66, or 107-175.

Embodiment 56 is the mRNA of any one of embodiments 37-43, wherein the mRNA comprises a sequence with at least 98% identity to SEQ ID NO: 10, 11, 12, 14, 15, 17, 18, 20, 21, 23, 24, 26, 27, 29, 30, 50, 52, 54, 65, 66, or 107-175.

Embodiment 57 is the mRNA of any one of embodiments 37-43, wherein the mRNA comprises a sequence 100% identical to SEQ ID NO: 10, 11, 12, 14, 15, 17, 18, 20, 21, 23, 24, 26, 27, 29, 30, 50, 52, 54, 65, 66, or 107-175.

Embodiment 58 is the mRNA of any one of embodiments 37-57, wherein the mRNA encodes a polypeptide comprising the amino acid sequence of SEQ ID NO: 3, 6, 8, or 186-196.

Embodiment 59 is the mRNA of any one of the preceding embodiments, wherein the RNA-guided DNA-binding agent further comprises a heterologous functional domain.

Embodiment 60 is the mRNA of embodiment 59, wherein the heterologous functional domain is a FokI nuclease.

Embodiment 61 is the mRNA of embodiment 59, wherein the heterologous functional domain is a transcriptional regulatory domain.

Embodiment 62 is the mRNA of any one of the preceding embodiments, wherein, when an effective amount of the mRNA is administered to a mammal together with a guide RNA that targets the TTR gene of the mammal in a pharmaceutical composition comprising lipid nanoparticles, an indel is formed in the TTR locus in at least 50% of the genomic DNA obtained from hepatocytes of the mammal.

Embodiment 63 is the mRNA of any one of the preceding embodiments, wherein, when an effective amount of the mRNA is administered to a mammal together with a guide RNA that targets the TTR gene of the mammal in a pharmaceutical composition comprising lipid nanoparticles, the concentration of TTR in the serum of the mammal is reduced by at least 50%.

Embodiment 64 is the mRNA of any of the preceding embodiments, wherein at least 10% of the uridine is substituted with a modified uridine.

Embodiment 65 is the mRNA of embodiment 64, wherein the modified uridine is one or more of N1-methyl-pseudouridine, pseudouridine, 5-methoxyuridine, or 5-iodouridine.

Embodiment 66 is the mRNA of embodiment 64, wherein the modified uridine is one or both of N1-methyl-pseudouridine or 5-methoxyuridine.

Embodiment 67 is the mRNA of embodiment 64, wherein the modified uridine is N1-methyl-pseudouridine.

Embodiment 68 is the mRNA of embodiment 64, wherein the modified uridine is 5-methoxyuridine.

Embodiment 69 is the mRNA of any one of embodiments 64-68, wherein 15% to 45% of the uridine is substituted with the modified uridine.

Embodiment 70 is the mRNA of any one of embodiments 64-68, wherein at least 20% or at least 30% of the uridine is substituted with the modified uridine.

Embodiment 71 is the mRNA of embodiment 70, wherein at least 80% or at least 90% of the uridine is substituted with the modified uridine.

Embodiment 72 is the mRNA of embodiment 70, wherein 100% uridine is substituted with the modified uridine.

Embodiment 73 is the mRNA of any one of embodiments 64-72, wherein, when an effective amount of the mRNA is administered to a mammal together with a guide RNA that targets the TTR gene of the mammal in a pharmaceutical composition comprising lipid nanoparticles, an indel is formed in the TTR locus in at least 70% or at least 90% of the genomic DNA obtained from hepatocytes of the mammal.

Embodiment 74 is the mRNA of any one of embodiments 64-73, wherein, when the mRNA is administered to a mammal together with a guide RNA that targets the TTR gene of the mammal in a pharmaceutical composition comprising lipid nanoparticles, the concentration of TTR in the serum of the mammal is reduced by at least 70% or at least 90%.

Embodiment 75 is the mRNA of embodiment 62, 63, 71, or 72, wherein the animal is a mouse and the guide RNA has a sequence consisting of SEQ ID NO: 42.

Embodiment 76 is the mRNA of embodiment 62, 63, 71, or 72, wherein the animal is a rat and the guide RNA has a sequence consisting of SEQ ID NO: 69.

Embodiment 77 is the mRNA of any one of the preceding embodiments, wherein the mRNA comprises a sequence with at least 90% identity to any one of SEQ ID NOs: 43, 44, 51, 53, 55-61, or 176-185.

Embodiment 78 is the mRNA of any one of the preceding embodiments, wherein the mRNA comprises a sequence with at least 95% identity to any one of SEQ ID NOs: 43, 44, 51, 53, 55-61, or 176-185.

Embodiment 79 is the mRNA of any one of the preceding embodiments, wherein the mRNA comprises a sequence with at least 98% identity to any one of SEQ ID NOs: 43, 44, 51, 53, 55-61, or 176-185.

Embodiment 80 is the mRNA of any one of the preceding embodiments, wherein the mRNA comprises a sequence with at least 99% identity to any one of SEQ ID NOs: 43, 44, 51, 53, 55-61, or 176-185.

Embodiment 81 is the mRNA of any one of the preceding embodiments, wherein the mRNA comprises a sequence with 100% identity to any one of SEQ ID NOs: 43, 44, 51, 53, 55-61, or 176-185.

Embodiment 82 is an expression construct comprising a promoter operably linked to a sequence encoding an mRNA according to any one of the preceding embodiments.

Embodiment 83 is a plasmid comprising the expression construct of embodiment 82.

Embodiment 84 is a host cell comprising the expression construct of embodiment 82 or the plasmid of embodiment 83.

Embodiment 85 is a method of preparing an mRNA comprising contacting the expression construct of embodiment 82 or the plasmid of embodiment 83 with an RNA polymerase under conditions permissive for transcription of the mRNA.

Embodiment 86 is the method of embodiment 85, wherein the contacting step is performed in vitro.

Embodiment 87 is a composition comprising an mRNA according to any one of embodiments 1-81 and at least one guide RNA.

Embodiment 88 is a lipid nanoparticle comprising an mRNA according to any one of embodiments 1-81.

Embodiment 89 is a pharmaceutical composition comprising an mRNA according to any one of embodiments 1-81 and a pharmaceutically acceptable carrier.

Embodiment 90 is the lipid nanoparticle of embodiment 88 or the pharmaceutical composition of embodiment 89, further comprising at least one guide RNA.

Embodiment 91 is the composition or lipid nanoparticle of any one of claims 87-90, wherein the at least one guide RNA targets TTR.

Embodiment 92 is a method of genome editing or modifying a target gene comprising contacting a cell with the mRNA, expression construct, composition, or lipid nanoparticle according to any one of claims 1-83 or 87-91.

Embodiment 93 is the use of the mRNA, expression construct, composition, or lipid nanoparticle according to any one of claims 1-83 or 87-91 for genome editing or modifying a target gene.

Embodiment 94 is the use of the mRNA, expression construct, composition, or lipid nanoparticle according to any one of claims 1-83 or 87-91 for the manufacture of a medicament for genome editing or modifying a target gene.

Embodiment 95 is the method or use of any one of claims 92-94, wherein the genome editing or modification of the target gene occurs in a liver cell.

Embodiment 96 is the method or use of claim 95, wherein the liver cell is a hepatocyte.

Embodiment 97 is the method or use of any one of claims 92-96, wherein the genome editing or modification of the target gene is in vivo.

Embodiment 98 is the method or use of any one of claims 92-97, wherein the genome editing or modification of the target gene is in an isolated or cultured cell.

| SEQ ID NO | Description |
| --- | --- |
| 1 | DNA coding sequence of Cas9 using the thymidine analog of the minimal uridine codons listed in Table 3, with start and stop codons |
| 2 | DNA coding sequence of Cas9 using codons with generally high expression in humans |
| 3 | Amino acid sequence of Cas9 with one nuclear localization signal (1 × NLS) as the C-terminal 7 amino acids |
| 4 | Cas9 mRNA ORF using minimal uridine codons as listed in Table 3, with start and stop codons |
| 5 | Cas9 mRNA ORF using codons with generally high expression in humans, with start and stop codons |
| 6 | Amino acid sequence of Cas9 nickase with 1xNLS as the C-terminal 7 amino acids |
| 7 | Cas9 nickase mRNA ORF encoding SEQ ID NO: 6 using minimal uridine codons as listed in Table 3, with start and stop codons |
| 8 | Amino acid sequence of dCas9 with 1xNLS as the C-terminal 7 amino acids |
| 9 | dCas9 mRNA ORF encoding SEQ ID NO: 8 using minimal uridine codons as listed in Table 3, with start and stop codons |
| 10 | Cas9 mRNA coding sequence using minimal uridine codons as listed in Table 3 (no start or stop codons; suitable for inclusion in fusion protein coding sequence) |
| 11 | Cas9 nickase mRNA coding sequence using minimal uridine codons as listed in Table 3 (no start or stop codons; suitable for inclusion in fusion protein coding sequence) |
| 12 | dCas9 mRNA coding sequence using minimal uridine codons as listed in Table 3 (no start or stop codons; suitable for inclusion in fusion protein coding sequence) |
| 13 | Amino acid sequence of Cas9 (without NLS) |
| 14 | Cas9 mRNA ORF encoding SEQ ID NO: 13 using minimal uridine codons as listed in Table 3, with start and stop codons |
| 15 | Cas9 coding sequence encoding SEQ ID NO: 13 using minimal uridine codons as listed in Table 3 (no start or stop codons; suitable for inclusion in fusion protein coding sequence) |
| 16 | Amino acid sequence of Cas9 nickase (without NLS) |
| 17 | Cas9 nickase mRNA ORF encoding SEQ ID NO: 16 using minimal uridine codons as listed in Table 3, with start and stop codons |
| 18 | Cas9 nickase coding sequence encoding SEQ ID NO: 16 using minimal uridine codons as listed in Table 3 (no start or stop codons; suitable for inclusion in fusion protein coding sequence) |
| 19 | Amino acid sequence of dCas9 (without NLS) |
| 20 | dCas9 mRNA ORF encoding SEQ ID NO: 13 using minimal uridine codons as listed in Table 3, with start and stop codons |
| 21 | dCas9 coding sequence encoding SEQ ID NO: 13 using minimal uridine codons as listed in Table 3 (no start or stop codons; suitable for inclusion in fusion protein coding sequence) |
| 22 | Amino acid sequence of Cas9 with two nuclear localization signals (2 × NLS) as the C-terminal amino acids |
| 23 | Cas9 mRNA ORF encoding SEQ ID NO: 13 using minimal uridine codons as listed in Table 3, with start and stop codons |
| 24 | Cas9 coding sequence encoding SEQ ID NO: 13 using minimal uridine codons as listed in Table 3 (no start or stop codons; suitable for inclusion in fusion protein coding sequence) |
| 25 | Amino acid sequence of Cas9 nickase with two nuclear localization signals as the C-terminal amino acids |
| 26 | Cas9 nickase mRNA ORF encoding SEQ ID NO: 16 using minimal uridine codons as listed in Table 3, with start and stop codons |
| 27 | Cas9 nickase coding sequence encoding SEQ ID NO: 16 using minimal uridine codons as listed in Table 3 (no start or stop codons; suitable for inclusion in fusion protein coding sequence) |
| 28 | Amino acid sequence of dCas9 with two nuclear localization signals as the C-terminal amino acids |
| 29 | dCas9 mRNA ORF encoding SEQ ID NO: 13 using minimal uridine codons as listed in Table 3, with start and stop codons |

| SEQ ID NO | Description |
|---|---|
| 30 | dCas9 coding sequence encoding SEQ ID NO: 13 using minimal uridine codons as listed in Table 3 (no start or stop codons; suitable for inclusion in fusion protein coding sequence) |
| 31 | T7 Promoter |
| 32 | Human beta-globin 5' UTR |
| 33 | Human beta-globin 3' UTR |
| 34 | Human alpha-globin 5' UTR |
| 35 | Human alpha-globin 3' UTR |
| 36 | *Xenopus laevis* beta-globin 5' UTR |
| 37 | *Xenopus laevis* beta-globin 3' UTR |
| 38 | Bovine Growth Hormone 5' UTR |
| 39 | Bovine Growth Hormone 3' UTR |
| 40 | *Mus musculus* hemoglobin alpha, adult chain 1 (Hba-a1), 3'UTR |
| 41 | HSD17B4 5' UTR |
| 42 | G282 single guide RNA targeting the mouse TTR gene |
| 43 | Cas9 transcript with 5' UTR of HSD, ORF corresponding to SEQ ID NO: 4, Kozak sequence, and 3' UTR of ALB |
| 44 | Cas9 transcript with 5' UTR of HSD, ORF corresponding to SEQ ID NO: 4, and 3' UTR of ALB |
| 45 | Alternative Cas9 ORF with 19.36% U content |
| 46 | Cas9 transcript with 5' UTR of HSD, ORF corresponding to SEQ ID NO: 45, Kozak sequence, and 3' UTR of ALB |
| 47 | Cas9 transcript with 5' UTR of HSD, ORF corresponding to SEQ ID NO: 45, and 3' UTR of ALB |
| 48 | Cas9 transcript comprising Cas9 ORF using codons with generally high expression in humans |
| 49 | Cas9 transcript comprising Kozak sequence with Cas9 ORF using codons with generally high expression in humans |
| 50 | Cas9 ORF with splice junctions removed; 12.75% U content |
| 51 | Cas9 transcript with 5' UTR of HSD, ORF corresponding to SEQ ID NO: 50, Kozak sequence, and 3' UTR of ALB |
| 52 | Cas9 ORF with minimal uridine codons frequently used in humans in general; 12.75% U content |
| 53 | Cas9 transcript with 5' UTR of HSD, ORF corresponding to SEQ ID NO: 52, Kozak sequence, and 3' UTR of ALB |
| 54 | Cas9 ORF with minimal uridine codons infrequently used in humans in general; 12.75% U content |
| 55 | Cas9 transcript with 5' UTR of HSD, ORF corresponding to SEQ ID NO: 54, Kozak sequence, and 3' UTR of ALB |
| 56 | Cas9 transcript with AGG as first three nucleotides for use with CleanCap ™, 5' UTR of HSD, ORF corresponding to SEQ ID NO: 4, Kozak sequence, and 3' UTR of ALB |
| 57 | Cas9 transcript with 5' UTR from CMV, ORF corresponding to SEQ ID NO: 4, Kozak sequence, and 3' UTR of ALB |
| 58 | Cas9 transcript with 5' UTR from HBB, ORF corresponding to SEQ ID NO: 4, Kozak sequence, and 3' UTR of HBB |
| 59 | Cas9 transcript with 5' UTR from XBG, ORF corresponding to SEQ ID NO: 4, Kozak sequence, and 3' UTR of XBG |
| 60 | Cas9 transcript with AGG as first three nucleotides for use with CleanCap ™, 5' UTR from XBG, ORF corresponding to SEQ ID NO: 4, Kozak sequence, and 3' UTR of XBG |
| 61 | Cas9 transcript with AGG as first three nucleotides for use with CleanCap ™, 5' UTR from HSD, ORF corresponding to SEQ ID NO: 4, Kozak sequence, and 3' UTR of ALB |
| 62 | 30/30/39 poly-A sequence |
| 63 | poly-A 100 sequence |
| 64 | G209 single guide RNA targeting the mouse TTR gene |
| 65 | ORF encoding *Neisseria meningitidis* Cas9 using minimal uridine codons as listed in Table 3, with start and stop codons |
| 66 | ORF encoding *Neisseria meningitidis* Cas9 using minimal uridine codons as listed in Table 3 (no start or stop codons; suitable for inclusion in fusion protein coding sequence) |
| 67 | Transcript comprising SEQ ID NO: 65 (encoding *Neisseria meningitidis* Cas9) |
| 68 | Amino acid sequence of *Neisseria meningitidis* Cas9 |
| 69 | G390 single guide RNA targeting the rat TTR gene |
| 70 | G502 single guide RNA targeting the cynomolgus monkey TTR gene |
| 71 | G509 single guide RNA targeting the cynomolgus monkey TTR gene |
| 72 | G534 single guide RNA targeting the rat TTR gene |
| 73 | DNA coding sequence of eGFP |
| 74 | Modified sgRNA pattern |
| 75 | CMV-1 5' UTR |
| 76 | CMV-2 5' UTR |
| 77 | CMV-3 5' UTR |
| 78 | SV40 NLS |

-continued

| SEQ ID NO | Description |
|---|---|
| 79 | Exemplary NLS 1 |
| 80 | Exemplary NLS 2 |
| 81 | Exemplary NLS 3 |
| 82 | Exemplary NLS 4 |
| 83 | Exemplary NLS 5 |
| 84 | Exemplary NLS 6 |
| 85 | Exemplary NLS 7 |
| 86 | Exemplary NLS 8 |
| 87 | Exemplary NLS 9 |
| 88 | Exemplary NLS 10 |
| 89 | Exemplary NLS 11 |
| 90 | Alternate SV40 NLS |
| 91 | Nucleoplasmin NLS |
| 92 | Exemplary coding sequence for SV40 NLS |
| 93 | Exemplary coding sequence for NLS1 |
| 94 | Exemplary coding sequence for NLS2 |
| 95 | Exemplary coding sequence for NLS3 |
| 96 | Exemplary coding sequence for NLS4 |
| 97 | Exemplary coding sequence for NLS5 |
| 98 | Exemplary coding sequence for NLS6 |
| 99 | Exemplary coding sequence for NLS7 |
| 100 | Exemplary coding sequence for NLS8 |
| 101 | Exemplary coding sequence for NLS9 |
| 102 | Exemplary coding sequence for NLS10 |
| 103 | Exemplary coding sequence for NLS11 |
| 104 | Exemplary coding sequence for alternate SV40 NLS |
| 105 | exemplary Kozak sequence |
| 107 | Cas9 ORF using long half life codons of Table 4, with start and stop codons |
| 108 | Cas9 ORF using U rich codons of Table 4, with start and stop codons |
| 109 | Cas9 ORF using low G codons of Table 4, with start and stop codons |
| 110 | Cas9 ORF using low C codons of Table 4, with start and stop codons |
| 111 | Cas9 ORF using low A codons of Table 4, with start and stop codons |
| 112 | Cas9 ORF using low A/U codons of Table 4, with start and stop codons |
| 113 | Cas9 ORF using low A codons of Table 4, with two C-terminal NLS sequences and start and stop codons |
| 114 | Cas9 nickase ORF using low A codons of Table 4, with start and stop codons |
| 115 | Cas9 nickase ORF using low A codons of Table 4, with start and stop codons and no NLS |
| 116 | Cas9 nickase ORF using low A codons of Table 4, with two C-terminal NLS sequences and start and stop codons |
| 117 | dCas9 ORF using low A codons of Table 4, with start and stop codons |
| 118 | dCas9 ORF using low A codons of Table 4, with start and stop codons and no NLS |
| 119 | dCas9 ORF using low A codons of Table 4, with two C-terminal NLS sequences and start and stop codons |
| 120 | Cas9 ORF using low A/U codons of Table 4, with two C-terminal NLS sequences and start and stop codons |
| 121 | Cas9 ORF using low A/U codons of Table 4, with start and stop codons and no NLS |
| 122 | Cas9 nickase ORF using low A/U codons of Table 4, with start and stop codons |
| 123 | Cas9 nickase ORF using low A/U codons of Table 4, with two C-terminal NLS sequences and start and stop codons |
| 124 | Cas9 nickase ORF using low A/U codons of Table 4, with start and stop codons and no NLS |
| 125 | dCas9 ORF using low A/U codons of Table 4, with start and stop codons |
| 126 | dCas9 ORF using low A/U codons of Table 4, with two C-terminal NLS sequences and start and stop codons |
| 127 | dCas9 ORF using low A/U codons of Table 4, with start and stop codons and no NLS |
| 128 | Nme Cas9 ORF using low A codons of Table 4, with start and stop codons |
| 129 | Nme Cas9 ORF using low A/U codons of Table 4, with start and stop codons |
| 130 | Open reading frame for Cas9 with NLS1, with start and stop codons |
| 131 | Open reading frame for Cas9 with NLS2, with start and stop codons |
| 132 | Open reading frame for Cas9 with NLS3, with start and stop codons |
| 133 | Open reading frame for Cas9 with NLS4, with start and stop codons |

| SEQ ID NO | Description |
| --- | --- |
| 134 | Open reading frame for Cas9 with NLS5, with start and stop codons |
| 135 | Open reading frame for Cas9 with NLS6, with start and stop codons |
| 136 | Open reading frame for Cas9 with NLS7, with start and stop codons |
| 137 | Open reading frame for Cas9 with NLS8, with start and stop codons |
| 138 | Open reading frame for Cas9 with NLS9, with start and stop codons |
| 139 | Open reading frame for Cas9 with NLS10, with start and stop codons |
| 140 | Open reading frame for Cas9 with NLS11, with start and stop codons |
| 141 | Cas9 ORF using codons with generally high expression in humans (no start or stop codons; suitable for inclusion in fusion protein coding sequence) |
| 142 | Cas9 ORF using long half life codons of Table 4 (no start or stop codons; suitable for inclusion in fusion protein coding sequence) |
| 143 | Cas9 ORF using U rich codons of Table 4 (no start or stop codons; suitable for inclusion in fusion protein coding sequence) |
| 144 | Cas9 ORF using low G codons of Table 4 (no start or stop codons; suitable for inclusion in fusion protein coding sequence) |
| 145 | Cas9 ORF using low C codons of Table 4 (no start or stop codons; suitable for inclusion in fusion protein coding sequence) |
| 146 | Cas9 ORF using low A codons of Table 4 (no start or stop codons; suitable for inclusion in fusion protein coding sequence) |
| 147 | Cas9 ORF using low A/U codons of Table 4 (no start or stop codons; suitable for inclusion in fusion protein coding sequence) |
| 148 | Cas9 ORF using low A codons of Table 4, with two C-terminal NLS sequences (no start or stop codons; suitable for inclusion in fusion protein coding sequence) |
| 149 | Cas9 nickase ORF using low A codons of Table 4 (no start or stop codons; suitable for inclusion in fusion protein coding sequence) |
| 150 | Cas9 nickase ORF using low A codons of Table 4 (no NLS and no start or stop codons; suitable for inclusion in fusion protein coding sequence) |
| 151 | Cas9 nickase ORF using low A codons of Table 4, with two C-terminal NLS sequences (no start or stop codons; suitable for inclusion in fusion protein coding sequence) |
| 152 | dCas9 ORF using low A codons of Table 4 (no start or stop codons; suitable for inclusion in fusion protein coding sequence) |
| 153 | dCas9 ORF using low A codons of Table 4 (no NLS and no start or stop codons; suitable for inclusion in fusion protein coding sequence) |
| 154 | dCas9 ORF using low A codons of Table 4, with two C-terminal NLS sequences (no start or stop codons; suitable for inclusion in fusion protein coding sequence) |
| 155 | Cas9 ORF using low A/U codons of Table 4, with two C-terminal NLS sequences (no start or stop codons; suitable for inclusion in fusion protein coding sequence) |
| 156 | Cas9 ORF using low A/U codons of Table 4 (no NLS and no start or stop codons; suitable for inclusion in fusion protein coding sequence) |
| 157 | Cas9 nickase ORF using low A/U codons of Table 4 (no start or stop codons; suitable for inclusion in fusion protein coding sequence) |
| 158 | Cas9 nickase ORF using low A/U codons of Table 4, with two C-terminal NLS sequences (no start or stop codons; suitable for inclusion in fusion protein coding sequence) |
| 159 | Cas9 nickase ORF using low A/U codons of Table 4 (no NLS and no start or stop codons; suitable for inclusion in fusion protein coding sequence) |
| 160 | dCas9 ORF using low A/U codons of Table 4 (no start or stop codons; suitable for inclusion in fusion protein coding sequence) |
| 161 | dCas9 ORF using low A/U codons of Table 4, with two C-terminal NLS sequences (no start or stop codons; suitable for inclusion in fusion protein coding sequence) |
| 162 | dCas9 ORF using low A/U codons of Table 4 (no NLS and no start or stop codons; suitable for inclusion in fusion protein coding sequence) |
| 163 | Nme Cas9 ORF using low A codons of Table 4 (no start or stop codons; suitable for inclusion in fusion protein coding sequence) |
| 164 | Nme Cas9 ORF using low A/U codons of Table 4 (no start or stop codons; suitable for inclusion in fusion protein coding sequence) |
| 165 | Open reading frame for Cas9 with NLS1 (no start or stop codons; suitable for inclusion in fusion protein coding sequence) |
| 166 | Open reading frame for Cas9 with NLS2 (no start or stop codons; suitable for inclusion in fusion protein coding sequence) |
| 167 | Open reading frame for Cas9 with NLS3 (no start or stop codons; suitable for inclusion in fusion protein coding sequence) |

| SEQ ID NO | Description |
|---|---|
| 168 | Open reading frame for Cas9 with NLS4 (no start or stop codons; suitable for inclusion in fusion protein coding sequence) |
| 169 | Open reading frame for Cas9 with NLS5 (no start or stop codons; suitable for inclusion in fusion protein coding sequence) |
| 170 | Open reading frame for Cas9 with NLS6 (no start or stop codons; suitable for inclusion in fusion protein coding sequence) |
| 171 | Open reading frame for Cas9 with NLS7 (no start or stop codons; suitable for inclusion in fusion protein coding sequence) |
| 172 | Open reading frame for Cas9 with NLS8 (no start or stop codons; suitable for inclusion in fusion protein coding sequence) |
| 173 | Open reading frame for Cas9 with NLS9 (no start or stop codons; suitable for inclusion in fusion protein coding sequence) |
| 174 | Open reading frame for Cas9 with NLS10 (no start or stop codons; suitable for inclusion in fusion protein coding sequence) |
| 175 | Open reading frame for Cas9 with NLS11 (no start or stop codons; suitable for inclusion in fusion protein coding sequence) |
| 176 | mRNA transcript with XBG UTRs and Cas9 ORF with low U 1 codons of Table 4 |
| 177 | mRNA transcript with XBG UTRs and Cas9 ORF with low A codons of Table 4 |
| 178 | mRNA transcript with XBG UTRs and Cas9 ORF with low U/A codons of Table 4 |
| 179 | mRNA transcript with ORF encoding Cas9 with HiBiT tag, HSD 5' UTR and human ALB 3' UTR |
| 180 | mRNA transcript with ORF encoding Cas9 with HiBiT tag, CMV-1 5' UTR and human ALB 3' UTR |
| 181 | mRNA transcript with ORF encoding Cas9 with HiBiT tag, CMV-2 5' UTR and human ALB 3' UTR |
| 182 | mRNA transcript with ORF encoding Cas9 with HiBiT tag, CMV-3 5' UTR and human ALB 3' UTR |
| 183 | mRNA transcript with ORF encoding Cas9 with HiBiT tag, HBA 5' UTR and human ALB 3' UTR |
| 184 | mRNA transcript with ORF encoding Cas9 with HiBiT tag, HBB 5' UTR and human ALB 3' UTR |
| 185 | mRNA transcript with ORF encoding Cas9 with HiBiT tag, XBG 5' UTR and human ALB 3' UTR |
| 186 | Amino acid sequence for Cas9 with NLS1 |
| 187 | Amino acid sequence for Cas9 with NLS2 |
| 188 | Amino acid sequence for Cas9 with NLS3 |
| 189 | Amino acid sequence for Cas9 with NLS4 |
| 190 | Amino acid sequence for Cas9 with NLS5 |
| 191 | Amino acid sequence for Cas9 with NLS6 |
| 192 | Amino acid sequence for Cas9 with NLS7 |
| 193 | Amino acid sequence for Cas9 with NLS8 |
| 194 | Amino acid sequence for Cas9 with NLS9 |
| 195 | Amino acid sequence for Cas9 with NLS10 |
| 196 | Amino acid sequence for Cas9 with NLS11 |
| 197 | G506 guide RNA targeting TTR |
| 198 | G510 guide RNA targeting TTR |

See the Sequence Table below for the sequences themselves. Transcript sequences generally include GGG as the first three nucleotides for use with ARCA or AGG as the first three nucleotides for use with CleanCap™. Accordingly, the first three nucleotides can be modified for use with other capping approaches, such as Vaccinia capping enzyme. Promoters and poly-A sequences are not included in the transcript sequences. A promoter such as a T7 promoter (SEQ ID NO: 31) and a poly-A sequence such as SEQ ID NO: 62 or 63 can be appended to the disclosed transcript sequences at the 5' and 3' ends, respectively. Most nucleotide sequences are provided as DNA but can be readily converted to RNA by changing Ts to Us.

DETAILED DESCRIPTION OF CERTAIN EMBODIMENTS

Figure 1A:
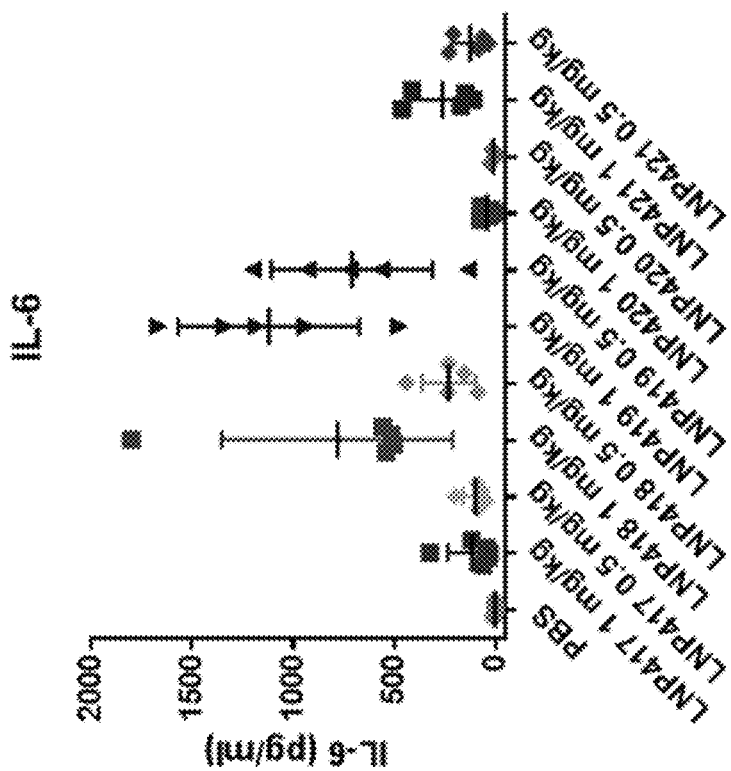
FIGS. 1A-1D show levels of IFN alpha, IL-6, TNF alpha, and MCP-1 following administration of PBS or lipid nanoparticle (LNP) formulations LNP417-LNP421 at 0.5 or 1 mg/kg (mpk).
Figure 1B:
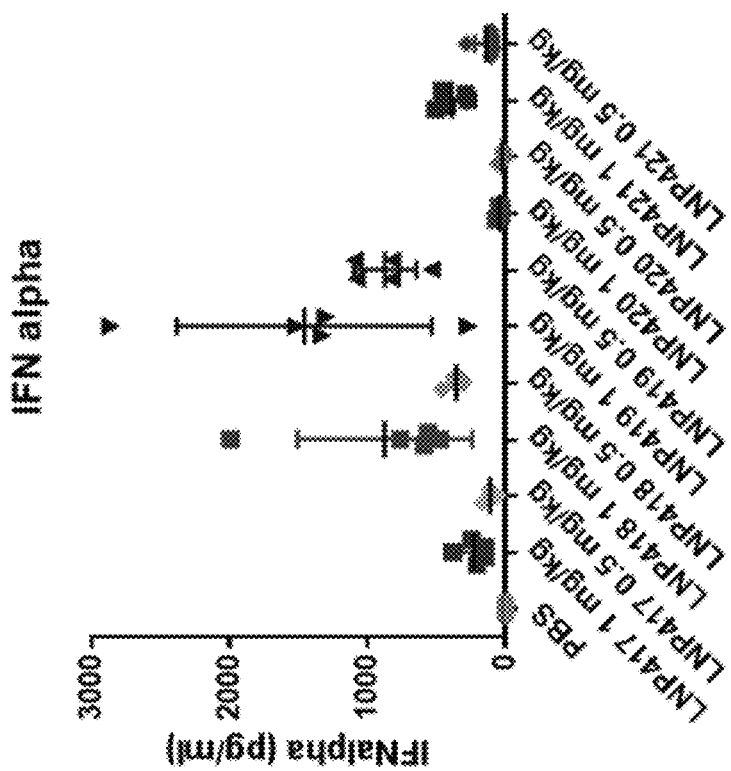
Figures 1C, 1D:
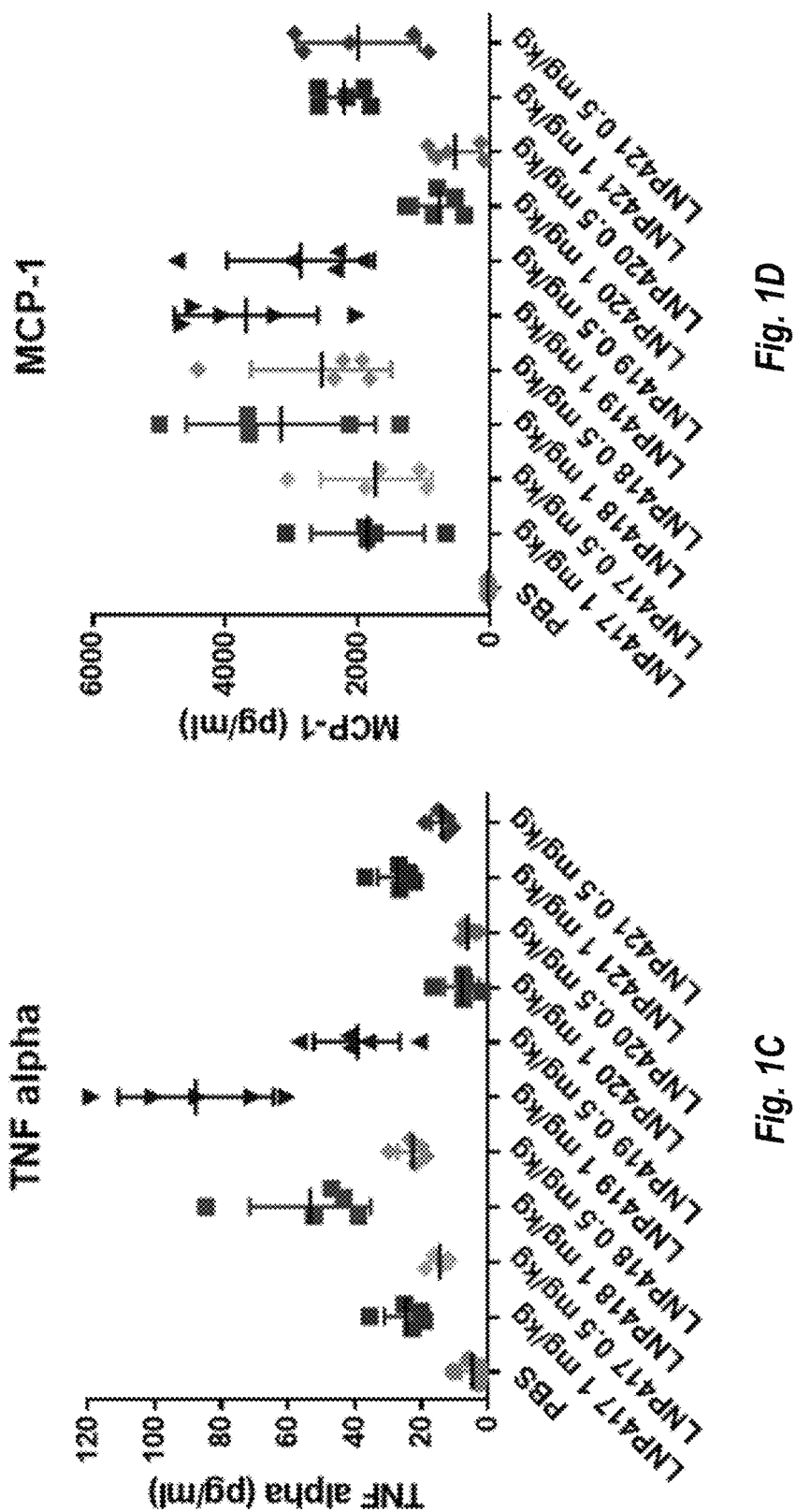

Reference will now be made in detail to certain embodiments of the invention, examples of which are illustrated in the accompanying drawings. While the invention will be described in conjunction with the illustrated embodiments, it will be understood that they are not intended to limit the invention to those embodiments. On the contrary, the invention is intended to cover all alternatives, modifications, and equivalents, which may be included within the invention as defined by the appended claims.

Before describing the present teachings in detail, it is to be understood that the disclosure is not limited to specific compositions or process steps, as such may vary. It should be noted that, as used in this specification and the appended claims, the singular form "a", "an" and "the" include plural references unless the context clearly dictates otherwise. Thus, for example, reference to "a conjugate" includes a plurality of conjugates and reference to "a cell" includes a plurality of cells and the like.

Numeric ranges are inclusive of the numbers defining the range. Measured and measureable values are understood to be approximate, taking into account significant digits and the error associated with the measurement. Also, the use of "comprise", "comprises", "comprising", "contain", "contains", "containing", "include", "includes", and "including" are not intended to be limiting. It is to be understood that both the foregoing general description and detailed description are exemplary and explanatory only and are not restrictive of the teachings.

The term "about" or "approximately" means an acceptable error for a particular value as determined by one of ordinary skill in the art, which depends in part on how the value is measured or determined, or a degree of variation that does not substantially affect the properties of the described subject matter, e.g., within 10%, 5%, 2%, or 1%. Accordingly, unless indicated to the contrary, the numerical parameters set forth in the following specification and attached claims are approximations that may vary depending upon the desired properties sought to be obtained. At the very least, and not as an attempt to limit the application of the doctrine of equivalents to the scope of the claims, each numerical parameter should at least be construed in light of the number of reported significant digits and by applying ordinary rounding techniques.

Unless specifically noted in the above specification, embodiments in the specification that recite "comprising" various components are also contemplated as "consisting of" or "consisting essentially of" the recited components; embodiments in the specification that recite "consisting of" various components are also contemplated as "comprising" or "consisting essentially of" the recited components; and embodiments in the specification that recite "consisting essentially of" various components are also contemplated as "consisting of" or "comprising" the recited components (this interchangeability does not apply to the use of these terms in the claims).

The section headings used herein are for organizational purposes only and are not to be construed as limiting the desired subject matter in any way. In the event that any literature incorporated by reference contradicts the express content of this specification, including but not limited to a definition, the express content of this specification controls. While the present teachings are described in conjunction with various embodiments, it is not intended that the present teachings be limited to such embodiments. On the contrary, the present teachings encompass various alternatives, modifications, and equivalents, as will be appreciated by those of skill in the art.

A. Definitions

Unless stated otherwise, the following terms and phrases as used herein are intended to have the following meanings:

The term "or combinations thereof" as used herein refers to all permutations and combinations of the listed terms preceding the term. For example, "A, B, C, or combinations thereof" is intended to include at least one of: A, B, C, AB, AC, BC, or ABC, and if order is important in a particular context, also BA, CA, CB, ACB, CBA, BCA, BAC, or CAB. Continuing with this example, expressly included are combinations that contain repeats of one or more item or term, such as BB, AAA, AAB, BBC, AAABCCCC, CBBAAA, CABABB, and so forth. The skilled artisan will understand that typically there is no limit on the number of items or terms in any combination, unless otherwise apparent from the context.

As used herein, the term "kit" refers to a packaged set of related components, such as one or more polynucleotides or compositions and one or more related materials such as delivery devices (e.g., syringes), solvents, solutions, buffers, instructions, or desiccants.

"Or" is used in the inclusive sense, i.e., equivalent to "and/or," unless the context requires otherwise.

"Polynucleotide" and "nucleic acid" are used herein to refer to a multimeric compound comprising nucleosides or nucleoside analogs which have nitrogenous heterocyclic bases or base analogs linked together along a backbone, including conventional RNA, DNA, mixed RNA-DNA, and polymers that are analogs thereof. A nucleic acid "backbone" can be made up of a variety of linkages, including one or more of sugar-phosphodiester linkages, peptide-nucleic acid bonds ("peptide nucleic acids" or PNA; PCT No. WO 95/32305), phosphorothioate linkages, methylphosphonate linkages, or combinations thereof. Sugar moieties of a nucleic acid can be ribose, deoxyribose, or similar compounds with substitutions, e.g., 2' methoxy or 2' halide substitutions. Nitrogenous bases can be conventional bases (A, G, C, T, U), analogs thereof (e.g., modified uridines such as 5-methoxyuridine, pseudouridine, or N1-methylpseudouridine, or others); inosine; derivatives of purines or pyrimidines (e.g., $N^4$-methyl deoxyguanosine, deaza- or aza-purines, deaza- or aza-pyrimidines, pyrimidine bases with substituent groups at the 5 or 6 position (e.g., 5-methylcytosine), purine bases with a substituent at the 2, 6, or 8 positions, 2-amino-6-methylaminopurine, $O^6$-methylguanine, 4-thio-pyrimidines, 4-amino-pyrimidines, 4-dimethylhydrazine-pyrimidines, and $O^4$-alkyl-pyrimidines; U.S. Pat. No. 5,378,825 and PCT No. WO 93/13121). For general discussion see *The Biochemistry of the Nucleic Acids* 5-36, Adams et al., ed., $11^{th}$ ed., 1992). Nucleic acids can include one or more "abasic" residues where the backbone includes no nitrogenous base for position(s) of the polymer (U.S. Pat. No. 5,585,481). A nucleic acid can comprise only conventional RNA or DNA sugars, bases and linkages, or can include both conventional components and substitutions (e.g., conventional bases with 2' methoxy linkages, or polymers containing both conventional bases and one or more base analogs). Nucleic acid includes "locked nucleic acid" (LNA), an analogue containing one or more LNA nucleotide monomers with a bicyclic furanose unit locked in an RNA mimicking sugar conformation, which enhance hybridization affinity toward complementary RNA and DNA sequences (Vester and Wengel, 2004, *Biochemistry* 43(42): 13233-41). RNA and DNA have different sugar moieties and can differ by the presence of uracil or analogs thereof in RNA and thymine or analogs thereof in DNA.

"Modified uridine" is used herein to refer to a nucleoside other than thymidine with the same hydrogen bond acceptors as uridine and one or more structural differences from uridine. In some embodiments, a modified uridine is a substituted uridine, i.e., a uridine in which one or more non-proton substituents (e.g., alkoxy, such as methoxy) takes the place of a proton. In some embodiments, a modified uridine is pseudouridine. In some embodiments, a modified uridine is a substituted pseudouridine, i.e., a pseudouridine in which one or more non-proton substituents (e.g., alkyl, such as methyl) takes the place of a proton. In some embodiments, a modified uridine is any of a substituted uridine, pseudouridine, or a substituted pseudouridine.

"Uridine position" as used herein refers to a position in a polynucleotide occupied by a uridine or a modified uridine. Thus, for example, a polynucleotide in which "100% of the uridine positions are modified uridines" contains a modified uridine at every position that would be a uridine in a conventional RNA (where all bases are standard A, U, C, or G bases) of the same sequence. Unless otherwise indicated, a U in a polynucleotide sequence of a sequence table or sequence listing in or accompanying this disclosure can be a uridine or a modified uridine.

As used herein, a first sequence is considered to "comprise a sequence with at least X % identity to" a second sequence if an alignment of the first sequence to the second sequence shows that X % or more of the positions of the second sequence in its entirety are matched by the first sequence. For example, the sequence AAGA comprises a sequence with 100% identity to the sequence AAG because an alignment would give 100% identity in that there are matches to all three positions of the second sequence. The differences between RNA and DNA (generally the exchange of uridine for thymidine or vice versa) and the presence of nucleoside analogs such as modified uridines do not contribute to differences in identity or complementarity among polynucleotides as long as the relevant nucleotides (such as thymidine, uridine, or modified uridine) have the same complement (e.g., adenosine for all of thymidine, uridine, or modified uridine; another example is cytosine and 5-methylcytosine, both of which have guanosine as a complement). Thus, for example, the sequence 5'-AXG where X is any modified uridine, such as pseudouridine, N1-methyl pseudouridine, or 5-methoxyuridirie, is considered 100% identical to AUG in that both are perfectly complementary to the same sequence (5'-CAU). Exemplary alignment algorithms are the Smith-Waterman and Needleman-Wunsch algorithms, which are well-known in the art. One skilled in the art will understand what choice of algorithm and parameter settings are appropriate for a given pair of sequences to be aligned; for sequences of generally similar length and expected identity >50% for amino acids or >75% for nucleotides, the Needleman-Wunsch algorithm with default settings of the Needleman-Wunsch algorithm interface provided by the EBI at the www.ebi.ac.uk web server are generally appropriate.

"mRNA" is used herein to refer to a polynucleotide that is not DNA and comprises an open reading frame that can be translated into a polypeptide (i.e., can serve as a substrate for translation by a ribosome and amino-acylated tRNAs). mRNA can comprise a phosphate-sugar backbone including ribose residues or analogs thereof, e.g., 2'-methoxy ribose residues. In some embodiments, the sugars of an mRNA phosphate-sugar backbone consist essentially of ribose residues, 2'-methoxy ribose residues, or a combination thereof. In general, mRNAs do not contain a substantial quantity of thymidine residues (e.g., 0 residues or fewer than 30, 20, 10, 5, 4, 3, or 2 thymidine residues; or less than 10%, 9%, 8%, 7%, 6%, 5%, 4%, 4%, 3%, 2%, 1%, 0.5%, 0.2%, or 0.1% thymidine content). An mRNA can contain modified uridines at some or all of its uridine positions.

As used herein, an "RNA-guided DNA binding agent" means a polypeptide or complex of polypeptides having RNA and DNA binding activity, or a DNA-binding subunit of such a complex, wherein the DNA binding activity is sequence-specific and depends on the sequence of the RNA. Exemplary RNA-guided DNA binding agents include Cas cleavases/nickases and inactivated forms thereof ("dCas DNA binding agents"). "Cas nuclease", also called "Cas protein", as used herein, encompasses Cas cleavases, Cas nickases, and dCas DNA binding agents. Cas cleavases/nickases and dCas DNA binding agents include a Csm or Cmr complex of a type III CRISPR system, the Cas10, Csm1, or Cmr2 subunit thereof, a Cascade complex of a type I CRISPR system, the Cas3 subunit thereof, and Class 2 Cas nucleases. As used herein, a "Class 2 Cas nuclease" is a single-chain polypeptide with RNA-guided DNA binding activity, such as a Cas9 nuclease or a Cpf1 nuclease. Class 2 Cas nucleases include Class 2 Cas cleavases and Class 2 Cas nickases (e.g., H840A, D10A, or N863A variants), which further have RNA-guided DNA cleavase or nickase activity, and Class 2 dCas DNA binding agents, in which cleavase/nickase activity is inactivated. Class 2 Cas nucleases include, for example, Cas9, Cpf1, C2c1, C2c2, C2c3, HF Cas9 (e.g., N497A, R661A, Q695A, Q926A variants), HypaCas9 (e.g., N692A, M694A, Q695A, H698A variants), eSPCas9(1.0) (e.g, K810A, K1003A, R1060A variants), and eSPCas9(1.1) (e.g., K848A, K1003A, R1060A variants) proteins and modifications thereof. Cpf1 protein, Zetsche et al., *Cell*, 163: 1-13 (2015), is homologous to Cas9, and contains a RuvC-like nuclease domain. Cpf1 sequences of Zetsche are incorporated by reference in their entirety. See, e.g., Zetsche, Tables S1 and S3. "Cas9" encompasses Spy Cas9, the variants of Cas9 listed herein, and equivalents thereof. See, e.g., Makarova et al., *Nat Rev Microbiol*, 13(11): 722-36 (2015); Shmakov et al., *Molecular Cell*, 60:385-397 (2015).

As used herein, the "minimum uridine content" of a given open reading frame (ORF) is the uridine content of an ORF that (a) uses a minimal uridine codon at every position and (b) encodes the same amino acid sequence as the given ORF. The minimal uridine codon(s) for a given amino acid is the codon(s) with the fewest uridines (usually 0 or 1 except for a codon for phenylalanine, where the minimal uridine codon has 2 uridines). Modified uridine residues are considered equivalent to uridines for the purpose of evaluating minimum uridine content.

As used herein, the "minimum uridine dinucleotide content" of a given open reading frame (ORF) is the lowest possible uridine dinucleotide (UU) content of an ORF that (a) uses a minimal uridine codon (as discussed above) at every position and (b) encodes the same amino acid sequence as the given ORF. The uridine dinucleotide (UU)

content can be expressed in absolute terms as the enumeration of UU dinucleotides in an ORF or on a rate basis as the percentage of positions occupied by the uridines of uridine dinucleotides (for example, AUUAU would have a uridine dinucleotide content of 40% because 2 of 5 positions are occupied by the uridines of a uridine dinucleotide). Modified uridine residues are considered equivalent to uridines for the purpose of evaluating minimum uridine dinucleotide content.

As used herein, the "minimum adenine content" of a given open reading frame (ORF) is the adenine content of an ORF that (a) uses a minimal adenine codon at every position and (b) encodes the same amino acid sequence as the given ORF. The minimal adenine codon(s) for a given amino acid is the codon(s) with the fewest adenines (usually 0 or 1 except for a codon for lysine and asparagine, where the minimal adenine codon has 2 adenines). Modified adenine residues are considered equivalent to adenines for the purpose of evaluating minimum adenine content.

As used herein, the "minimum adenine dinucleotide content" of a given open reading frame (ORF) is the lowest possible adenine dinucleotide (AA) content of an ORF that (a) uses a minimal adenine codon (as discussed above) at every position and (b) encodes the same amino acid sequence as the given ORF. The adenine dinucleotide (AA) content can be expressed in absolute terms as the enumeration of AA dinucleotides in an ORF or on a rate basis as the percentage of positions occupied by the adenines of adenine dinucleotides (for example, UAAUA would have an adenine dinucleotide content of 40% because 2 of 5 positions are occupied by the adenines of an adenine dinucleotide). Modified adenine residues are considered equivalent to adenines for the purpose of evaluating minimum adenine dinucleotide content.

"Guide RNA", "gRNA", and "guide" are used herein interchangeably to refer to either a crRNA (also known as CRISPR RNA), or the combination of a crRNA and a trRNA (also known as tracrRNA). The crRNA and trRNA may be associated as a single RNA molecule (single guide RNA, sgRNA) or in two separate RNA molecules (dual guide RNA, dgRNA). "Guide RNA" or "gRNA" refers to each type. The trRNA may be a naturally-occurring sequence, or a trRNA sequence with modifications or variations compared to naturally-occurring sequences.

As used herein, a "guide sequence" refers to a sequence within a guide RNA that is complementary to a target sequence and functions to direct a guide RNA to a target sequence for binding or modification (e.g., cleavage) by an RNA-guided DNA binding agent. A "guide sequence" may also be referred to as a "targeting sequence," or a "spacer sequence." A guide sequence can be 20 base pairs in length, e.g., in the case of *Streptococcus pyogenes* (i.e., Spy Cas9) and related Cas9 homologs/orthologs. Shorter or longer sequences can also be used as guides, e.g., 15-, 16-, 17-, 18-, 19-, 21-, 22-, 23-, 24-, or 25-nucleotides in length. In some embodiments, the target sequence is in a gene or on a chromosome, for example, and is complementary to the guide sequence. In some embodiments, the degree of complementarity or identity between a guide sequence and its corresponding target sequence may be about 75%, 80%, 85%, 90%, 95%, 96%, 97%, 98%, 99%, or 100%. In some embodiments, the guide sequence and the target region may be 100% complementary or identical. In other embodiments, the guide sequence and the target region may contain at least one mismatch. For example, the guide sequence and the target sequence may contain 1, 2, 3, or 4 mismatches, where the total length of the target sequence is at least 17, 18, 19, 20 or more base pairs. In some embodiments, the guide sequence and the target region may contain 1-4 mismatches where the guide sequence comprises at least 17, 18, 19, 20 or more nucleotides. In some embodiments, the guide sequence and the target region may contain 1, 2, 3, or 4 mismatches where the guide sequence comprises 20 nucleotides.

Target sequences for Cas proteins include both the positive and negative strands of genomic DNA (i.e., the sequence given and the sequence's reverse compliment), as a nucleic acid substrate for a Cas protein is a double stranded nucleic acid. Accordingly, where a guide sequence is said to be "complementary to a target sequence", it is to be understood that the guide sequence may direct a guide RNA to bind to the reverse complement of a target sequence. Thus, in some embodiments, where the guide sequence binds the reverse complement of a target sequence, the guide sequence is identical to certain nucleotides of the target sequence (e.g., the target sequence not including the PAM) except for the substitution of U for T in the guide sequence.

As used herein, "indels" refer to insertion/deletion mutations consisting of a number of nucleotides that are either inserted or deleted at the site of double-stranded breaks (DSBs) in the nucleic acid.

As used herein, "knockdown" refers to a decrease in expression of a particular gene product (e.g., protein, mRNA, or both). Knockdown of a protein can be measured either by detecting protein secreted by tissue or population of cells (e.g., in serum or cell media) or by detecting total cellular amount of the protein from a tissue or cell population of interest. Methods for measuring knockdown of mRNA are known and include sequencing of mRNA isolated from a tissue or cell population of interest. In some embodiments, "knockdown" may refer to some loss of expression of a particular gene product, for example a decrease in the amount of mRNA transcribed or a decrease in the amount of protein expressed or secreted by a population of cells (including in vivo populations such as those found in tissues).

As used herein, "knockout" refers to a loss of expression of a particular protein in a cell. Knockout can be measured either by detecting the amount of protein secretion from a tissue or population of cells (e.g., in serum or cell media) or by detecting total cellular amount of a protein a tissue or a population of cells. In some embodiments, the methods of the disclosure "knockout" a target protein one or more cells (e.g., in a population of cells including in vivo populations such as those found in tissues). In some embodiments, a knockout is not the formation of mutant of the target protein, for example, created by indels, but rather the complete loss of expression of the target protein in a cell.

As used herein, "ribonucleoprotein" (RNP) or "RNP complex" refers to a guide RNA together with an RNA-guided DNA binding agent, such as a Cas cleavase, nickase, or dCas DNA binding agent (e.g., Cas9). In some embodiments, the guide RNA guides the RNA-guided DNA binding agent such as Cas9 to a target sequence, and the guide RNA hybridizes with and the agent binds to the target sequence; in cases where the agent is a cleavase or nickase, binding can be followed by cleaving or nicking.

As used herein, a "target sequence" refers to a sequence of nucleic acid in a target gene that has complementarity to the guide sequence of the gRNA. The interaction of the target sequence and the guide sequence directs an RNA-guided DNA binding agent to bind, and potentially nick or cleave (depending on the activity of the agent), within the target sequence.

As used herein, "treatment" refers to any administration or application of a therapeutic for disease or disorder in a subject, and includes inhibiting the disease, arresting its development, relieving one or more symptoms of the disease, curing the disease, or preventing reoccurrence of one or more symptoms of the disease.

B. Exemplary Polynucleotides and Compositions 1. mRNAs and ORFs with Low Uridine Content In some embodiments, an mRNA is provided that encodes an RNA-guided DNA-binding agent comprising an open reading frame (ORF) having a uridine content ranging from its minimum uridine content to about 150% of its minimum uridine content. In some embodiments, the uridine content of the ORF is less than or equal to about 145%, 140%, 135%, 130%, 125%, 120%, 115%, 110%, 105%, 104%, 103%, 102%, or 101% of its minimum uridine content. In some embodiments, an mRNA is provided that encodes an RNA-guided DNA-binding agent comprising an open reading frame (ORF) having a uridine content equal to its minimum uridine content. In some embodiments, an mRNA is provided that encodes an RNA-guided DNA-binding agent comprising an open reading frame (ORF) having a uridine content less than or equal to about 150% of its minimum uridine content. In some embodiments, an mRNA is provided that encodes an RNA-guided DNA-binding agent comprising an open reading frame (ORF) having a uridine content less than or equal to about 145% of its minimum uridine content. In some embodiments, an mRNA is provided that encodes an RNA-guided DNA-binding agent comprising an open reading frame (ORF) having a uridine content less than or equal to about 140% of its minimum uridine content. In some embodiments, an mRNA is provided that encodes an RNA-guided DNA-binding agent comprising an open reading frame (ORF) having a uridine content less than or equal to about 135% of its minimum uridine content. In some embodiments, an mRNA is provided that encodes an RNA-guided DNA-binding agent comprising an open reading frame (ORF) having a uridine content less than or equal to about 130% of its minimum uridine content. In some embodiments, an mRNA is provided that encodes an RNA-guided DNA-binding agent comprising an open reading frame (ORF) having a uridine content less than or equal to about 125% of its minimum uridine content. In some embodiments, an mRNA is provided that encodes an RNA-guided DNA-binding agent comprising an open reading frame (ORF) having a uridine content less than or equal to about 120% of its minimum uridine content. In some embodiments, an mRNA is provided that encodes an RNA-guided DNA-binding agent comprising an open reading frame (ORF) having a uridine content less than or equal to about 115% of its minimum uridine content. In some embodiments, an mRNA is provided that encodes an RNA-guided DNA-binding agent comprising an open reading frame (ORF) having a uridine content less than or equal to about 110% of its minimum uridine content. In some embodiments, an mRNA is provided that encodes an RNA-guided DNA-binding agent comprising an open reading frame (ORF) having a uridine content less than or equal to about 105% of its minimum uridine content. In some embodiments, an mRNA is provided that encodes an RNA-guided DNA-binding agent comprising an open reading frame (ORF) having a uridine content less than or equal to about 104% of its minimum uridine content. In some embodiments, an mRNA is provided that encodes an RNA-guided DNA-binding agent comprising an open reading frame (ORF) having a uridine content less than or equal to about 103% of its minimum uridine content. In some embodiments, an mRNA is provided that encodes an RNA-guided DNA-binding agent comprising an open reading frame (ORF) having a uridine content less than or equal to about 102% of its minimum uridine content. In some embodiments, an mRNA is provided that encodes an RNA-guided DNA-binding agent comprising an open reading frame (ORF) having a uridine content less than or equal to about 101% of its minimum uridine content.

In some embodiments, an mRNA is provided that encodes an RNA-guided DNA-binding agent comprising an open reading frame (ORF) having a uridine dinucleotide content ranging from its minimum uridine dinucleotide content to 200% of its minimum uridine dinucleotide content. In some embodiments, the uridine dinucleotide content of the ORF is less than or equal to about 195%, 190%, 185%, 180%, 175%, 170%, 165%, 160%, 155%, 150%, 145%, 140%, 135%, 130%, 125%, 120%, 115%, 110%, 105%, 104%, 103%, 102%, or 101% of its minimum uridine dinucleotide content. In some embodiments, an mRNA is provided that encodes an RNA-guided DNA-binding agent comprising an open reading frame (ORF) having a uridine dinucleotide content equal to its minimum uridine dinucleotide content. In some embodiments, an mRNA is provided that encodes an RNA-guided DNA-binding agent comprising an open reading frame (ORF) having a uridine dinucleotide content less than or equal to about 200% of its minimum uridine dinucleotide content. In some embodiments, an mRNA is provided that encodes an RNA-guided DNA-binding agent comprising an open reading frame (ORF) having a uridine dinucleotide content less than or equal to about 195% of its minimum uridine dinucleotide content. In some embodiments, an mRNA is provided that encodes an RNA-guided DNA-binding agent comprising an open reading frame (ORF) having a uridine dinucleotide content less than or equal to about 190% of its minimum uridine dinucleotide content. In some embodiments, an mRNA is provided that encodes an RNA-guided DNA-binding agent comprising an open reading frame (ORF) having a uridine dinucleotide content less than or equal to about 185% of its minimum uridine dinucleotide content. In some embodiments, an mRNA is provided that encodes an RNA-guided DNA-binding agent comprising an open reading frame (ORF) having a uridine dinucleotide content less than or equal to about 180% of its minimum uridine dinucleotide content. In some embodiments, an mRNA is provided that encodes an RNA-guided DNA-binding agent comprising an open reading frame (ORF) having a uridine dinucleotide content less than or equal to about 175% of its minimum uridine dinucleotide content. In some embodiments, an mRNA is provided that encodes an RNA-guided DNA-binding agent comprising an open reading frame (ORF) having a uridine dinucleotide content less than or equal to about 170% of its minimum uridine dinucleotide content. In some embodiments, an mRNA is provided that encodes an RNA-guided DNA-binding agent comprising an open reading frame (ORF) having a uridine dinucleotide content less than or equal to about 165% of its minimum uridine dinucleotide content. In some embodiments, an mRNA is provided that encodes an RNA-guided DNA-binding agent comprising an open reading frame (ORF) having a uridine dinucleotide content less than or equal to about 160% of its minimum uridine dinucleotide content. In some embodiments, an mRNA is provided that encodes an RNA-guided DNA-binding agent comprising an open reading frame (ORF)

having a uridine dinucleotide content less than or equal to about 155% of its minimum uridine dinucleotide content. In some embodiments, an mRNA is provided that encodes an RNA-guided DNA-binding agent comprising an open reading frame (ORF) having a uridine dinucleotide content equal to its minimum uridine dinucleotide content. In some embodiments, an mRNA is provided that encodes an RNA-guided DNA-binding agent comprising an open reading frame (ORF) having a uridine dinucleotide content less than or equal to about 150% of its minimum uridine dinucleotide content. In some embodiments, an mRNA is provided that encodes an RNA-guided DNA-binding agent comprising an open reading frame (ORF) having a uridine dinucleotide content less than or equal to about 145% of its minimum uridine dinucleotide content. In some embodiments, an mRNA is provided that encodes an RNA-guided DNA-binding agent comprising an open reading frame (ORF) having a uridine dinucleotide content less than or equal to about 140% of its minimum uridine dinucleotide content. In some embodiments, an mRNA is provided that encodes an RNA-guided DNA-binding agent comprising an open reading frame (ORF) having a uridine dinucleotide content less than or equal to about 135% of its minimum uridine dinucleotide content. In some embodiments, an mRNA is provided that encodes an RNA-guided DNA-binding agent comprising an open reading frame (ORF) having a uridine dinucleotide content less than or equal to about 130% of its minimum uridine dinucleotide content. In some embodiments, an mRNA is provided that encodes an RNA-guided DNA-binding agent comprising an open reading frame (ORF) having a uridine dinucleotide content less than or equal to about 125% of its minimum uridine dinucleotide content. In some embodiments, an mRNA is provided that encodes an RNA-guided DNA-binding agent comprising an open reading frame (ORF) having a uridine dinucleotide content less than or equal to about 120% of its minimum uridine dinucleotide content. In some embodiments, an mRNA is provided that encodes an RNA-guided DNA-binding agent comprising an open reading frame (ORF) having a uridine dinucleotide content less than or equal to about 115% of its minimum uridine dinucleotide content. In some embodiments, an mRNA is provided that encodes an RNA-guided DNA-binding agent comprising an open reading frame (ORF) having a uridine dinucleotide content less than or equal to about 110% of its minimum uridine dinucleotide content. In some embodiments, an mRNA is provided that encodes an RNA-guided DNA-binding agent comprising an open reading frame (ORF) having a uridine dinucleotide content less than or equal to about 105% of its minimum uridine dinucleotide content. In some embodiments, an mRNA is provided that encodes an RNA-guided DNA-binding agent comprising an open reading frame (ORF) having a uridine dinucleotide content less than or equal to about 104% of its minimum uridine dinucleotide content. In some embodiments, an mRNA is provided that encodes an RNA-guided DNA-binding agent comprising an open reading frame (ORF) having a uridine dinucleotide content less than or equal to about 103% of its minimum uridine dinucleotide content. In some embodiments, an mRNA is provided that encodes an RNA-guided DNA-binding agent comprising an open reading frame (ORF) having a uridine dinucleotide content less than or equal to about 102% of its minimum uridine dinucleotide content. In some embodiments, an mRNA is provided that encodes an RNA-guided DNA-binding agent comprising an open reading frame (ORF) having a uridine dinucleotide content less than or equal to about 101% of its minimum uridine dinucleotide content.

In some embodiments, an mRNA is provided that encodes an RNA-guided DNA-binding agent comprising an open reading frame (ORF) having a uridine dinucleotide content ranging from its minimum uridine dinucleotide content to the uridine dinucleotide content that is 90% or lower of the maximum uridine dinucleotide content of a reference sequence that encodes the same protein as the mRNA in question. In some embodiments, the uridine dinucleotide content of the ORF is less than or equal to about 85%, 80%, 75%, 70%, 65%, 60%, 55%, 50%, 45%, 40%, 35%, 30%, 25%, 20%, 15%, 10%, or 5% of the maximum uridine dinucleotide content of a reference sequence that encodes the same protein as the mRNA in question.

In some embodiments, an mRNA is provided that encodes an RNA-guided DNA-binding agent comprising an open reading frame (ORF) having a uridine trinucleotide content ranging from 0 uridine trinucleotides to 1, 2, 3, 4, 5, 6, 7, 8, 9, 10, 20, 30, 40, or 50 uridine trinucleotides (where a longer run of uridines counts as the number of unique three-uridine segments within it, e.g., a uridine tetranucleotide contains two uridine trinucleotides, a uridine pentanucleotide contains three uridine trinucleotides, etc.). In some embodiments, an mRNA is provided that encodes an RNA-guided DNA-binding agent comprising an open reading frame (ORF) having a uridine trinucleotide content ranging from 0% uridine trinucleotides to 0.1%, 0.2%, 0.3%, 0.4%, 0.5%, 0.6%, 0.7%, 0.8%, 0.9%, 1%, 1.5%, or 2% uridine trinucleotides, where the percentage content of uridine trinucleotides is calculated as the percentage of positions in a sequence that are occupied by uridines that form part of a uridine trinucleotide (or longer run of uridines), such that the sequences UUUAAA and UUUUAAAA would each have a uridine trinucleotide content of 50%. For example, in some embodiments, the ORF has a uridine trinucleotide content less than or equal to 2%. For example, in some embodiments, the ORF has a uridine trinucleotide content less than or equal to 1.5%. In some embodiments, the ORF has a uridine trinucleotide content less than or equal to 1%. In some embodiments, the ORF has a uridine trinucleotide content less than or equal to 0.9%. In some embodiments, the ORF has a uridine trinucleotide content less than or equal to 0.8%. In some embodiments, the ORF has a uridine trinucleotide content less than or equal to 0.7%. In some embodiments, the ORF has a uridine trinucleotide content less than or equal to 0.6%. In some embodiments, the ORF has a uridine trinucleotide content less than or equal to 0.5%. In some embodiments, the ORF has a uridine trinucleotide content less than or equal to 0.4%. In some embodiments, the ORF has a uridine trinucleotide content less than or equal to 0.3%. In some embodiments, the ORF has a uridine trinucleotide content less than or equal to 0.2%. In some embodiments, the ORF has a uridine trinucleotide content less than or equal to 0.1%. In some embodiments, an mRNA is provided that encodes an RNA-guided DNA-binding agent comprising an open reading frame (ORF) containing no uridine trinucleotides.

In some embodiments, an mRNA is provided that encodes an RNA-guided DNA-binding agent comprising an open reading frame (ORF) having a uridine trinucleotide content ranging from its minimum uridine trinucleotide content to the uridine trinucleotide content that is 90% or lower of the maximum uridine trinucleotide content of a reference sequence that encodes the same protein as the mRNA in question. In some embodiments, the uridine trinucleotide content of the ORF is less than or equal to about 85%, 80%, 75%, 70%, 65%, 60%, 55%, 50%, 45%, 40%, 35%, 30%, 25%, 20%, 15%, 10%, or 5% of the maximum uridine trinucleotide content of a reference sequence that encodes the same protein as the mRNA in question.

In some embodiments, an mRNA is provided that encodes an RNA-guided DNA-binding agent comprising an open reading frame (ORF) having minimal nucleotide homopolymers, e.g., repetitive strings of the same nucleotides. For example, in some embodiments, when selecting a minimal uridine codon from the codons listed in Table 1, an mRNA is constructed by selecting the minimal uridine codons that reduce the number and length of nucleotide homopolymers, e.g., selecting GCA instead of GCC for alanine or selecting GGA instead of GGG for glycine or selecting AAG instead of AAA for lysine.

A given ORF can be reduced in uridine content or uridine dinucleotide content or uridine trinucleotide content, for example, by using minimal uridine codons in a sufficient fraction of the ORF. For example, an amino acid sequence for an RNA-guided DNA-binding agent can be back-translated into an ORF sequence by converting amino acids to codons, wherein some or all of the ORF uses the exemplary minimal uridine codons shown below. In some embodiments, at least about 50%, 55%, 60%, 65%, 70%, 75%, 80%, 85%, 90%, 95%, 98%, 99%, or 100% of the codons in the ORF are codons listed in Table 1.

TABLE 1

Exemplary minimal uridine codons

| | Amino Acid | Minimal uridine codon |
|---|---|---|
| A | Alanine | GCA or GCC or GCG |
| G | Glycine | GGA or GGC or GGG |
| V | Valine | GUC or GUA or GUG |
| D | Aspartic acid | GAC |
| E | Glutamic acid | GAA or GAG |
| I | Isoleucine | AUC or AUA |
| T | Threonine | ACA or ACC or ACG |
| N | Asparagine | AAC |
| K | Lysine | AAG or AAA |
| S | Serine | AGC |
| R | Arginine | AGA or AGG |
| L | Leucine | CUG or CUA or CUC |
| P | Proline | CCG or CCA or CCC |
| H | Histidine | CAC |
| Q | Glutamine | CAG or CAA |
| F | Phenylalanine | UUC |
| Y | Tyrosine | UAC |
| C | Cysteine | UGC |
| W | Tryptophan | UGG |
| M | Methionine | AUG |

In some embodiments, an mRNA is provided that encodes an RNA-guided DNA-binding agent comprising an open reading frame (ORF) consisting of a set of codons of which at least about 75%, 80%, 85%, 90%, 95%, 98%, 99%, or 100% of the codons are codons listed in Table 1.

2. mRNAs and ORFs with Low Adenine Content

In some embodiments, an mRNA is provided that encodes an RNA-guided DNA-binding agent comprising an open reading frame (ORF) having an adenine content ranging from its minimum adenine content to about 150% of its minimum adenine content. In some embodiments, the adenine content of the ORF is less than or equal to about 145%, 140%, 135%, 130%, 125%, 120%, 115%, 110%, 105%, 104%, 103%, 102%, or 101% of its minimum adenine content. In some embodiments, an mRNA is provided that encodes an RNA-guided DNA-binding agent comprising an open reading frame (ORF) having an adenine content equal to its minimum adenine content. In some embodiments, an mRNA is provided that encodes an RNA-guided DNA-binding agent comprising an open reading frame (ORF) having an adenine content less than or equal to about 150% of its minimum adenine content. In some embodiments, an mRNA is provided that encodes an RNA-guided DNA-binding agent comprising an open reading frame (ORF) having an adenine content less than or equal to about 145% of its minimum adenine content. In some embodiments, an mRNA is provided that encodes an RNA-guided DNA-binding agent comprising an open reading frame (ORF) having an adenine content less than or equal to about 140% of its minimum adenine content. In some embodiments, an mRNA is provided that encodes an RNA-guided DNA-binding agent comprising an open reading frame (ORF) having an adenine content less than or equal to about 135% of its minimum adenine content. In some embodiments, an mRNA is provided that encodes an RNA-guided DNA-binding agent comprising an open reading frame (ORF) having an adenine content less than or equal to about 130% of its minimum adenine content. In some embodiments, an mRNA is provided that encodes an RNA-guided DNA-binding agent comprising an open reading frame (ORF) having an adenine content less than or equal to about 125% of its minimum adenine content. In some embodiments, an mRNA is provided that encodes an RNA-guided DNA-binding agent comprising an open reading frame (ORF) having an adenine content less than or equal to about 120% of its minimum adenine content. In some embodiments, an mRNA is provided that encodes an RNA-guided DNA-binding agent comprising an open reading frame (ORF) having an adenine content less than or equal to about 115% of its minimum adenine content. In some embodiments, an mRNA is provided that encodes an RNA-guided DNA-binding agent comprising an open reading frame (ORF) having an adenine content less than or equal to about 110% of its minimum adenine content. In some embodiments, an mRNA is provided that encodes an RNA-guided DNA-binding agent comprising an open reading frame (ORF) having an adenine content less than or equal to about 105% of its minimum adenine content. In some embodiments, an mRNA is provided that encodes an RNA-guided DNA-binding agent comprising an open reading frame (ORF) having an adenine content less than or equal to about 104% of its minimum adenine content. In some embodiments, an mRNA is provided that encodes an RNA-guided DNA-binding agent comprising an open reading frame (ORF) having an adenine content less than or equal to about 103% of its minimum adenine content. In some embodiments, an mRNA is provided that encodes an RNA-guided DNA-binding agent comprising an open reading frame (ORF) having an adenine content less than or equal to about 102% of its minimum adenine content. In some embodiments, an mRNA is provided that encodes an RNA-guided DNA-binding agent comprising an open reading frame (ORF) having an adenine content less than or equal to about 101% of its minimum adenine content.

In some embodiments, an mRNA is provided that encodes an RNA-guided DNA-binding agent comprising an open reading frame (ORF) having an adenine dinucleotide content ranging from its minimum adenine dinucleotide content to about 200% of its minimum adenine dinucleotide content. In some embodiments, the adenine dinucleotide content of the ORF is less than or equal to about 195%, 190%, 185%, 180%, 175%, 170%, 165%, 160%, 155%, 150%, 145%, 140%, 135%, 130%, 125%, 120%, 115%, 110%, 105%, 104%, 103%, 102%, or 101% of its minimum adenine dinucleotide content. In some embodiments, an mRNA is provided that encodes an RNA-guided DNA-binding agent comprising an open reading frame (ORF) having an adenine dinucleotide content equal to its minimum adenine dinucleotide content. In some embodiments, an mRNA is provided that encodes an RNA-guided DNA-binding agent comprising an open reading frame (ORF) having an adenine dinucleotide content less than or equal to about 200% of its minimum adenine dinucleotide content. In some embodiments, an mRNA is provided that encodes an RNA-guided DNA-binding agent comprising an open reading frame (ORF) having an adenine dinucleotide content less than or equal to about 195% of its minimum adenine dinucleotide content. In some embodiments, an mRNA is provided that encodes an RNA-guided DNA-binding agent comprising an open reading frame (ORF) having an adenine dinucleotide content less than or equal to about 190% of its minimum adenine dinucleotide content. In some embodiments, an mRNA is provided that encodes an RNA-guided DNA-binding agent comprising an open reading frame (ORF) having an adenine dinucleotide content less than or equal to about 185% of its minimum adenine dinucleotide content. In some embodiments, an mRNA is provided that encodes an RNA-guided DNA-binding agent comprising an open reading frame (ORF) having an adenine dinucleotide content less than or equal to about 180% of its minimum adenine dinucleotide content. In some embodiments, an mRNA is provided that encodes an RNA-guided DNA-binding agent comprising an open reading frame (ORF) having an adenine dinucleotide content less than or equal to about 175% of its minimum adenine dinucleotide content. In some embodiments, an mRNA is provided that encodes an RNA-guided DNA-binding agent comprising an open reading frame (ORF) having an adenine dinucleotide content less than or equal to about 170% of its minimum adenine dinucleotide content. In some embodiments, an mRNA is provided that encodes an RNA-guided DNA-binding agent comprising an open reading frame (ORF) having an adenine dinucleotide content less than or equal to about 165% of its minimum adenine dinucleotide content. In some embodiments, an mRNA is provided that encodes an RNA-guided DNA-binding agent comprising an open reading frame (ORF) having an adenine dinucleotide content less than or equal to about 160% of its minimum adenine dinucleotide content. In some embodiments, an mRNA is provided that encodes an RNA-guided DNA-binding agent comprising an open reading frame (ORF) having an adenine dinucleotide content less than or equal to about 155% of its minimum adenine dinucleotide content. In some embodiments, an mRNA is provided that encodes an RNA-guided DNA-binding agent comprising an open reading frame (ORF) having an adenine dinucleotide content equal to its minimum adenine dinucleotide content. In some embodiments, an mRNA is provided that encodes an RNA-guided DNA-binding agent comprising an open reading frame (ORF) having an adenine dinucleotide content less than or equal to about 150% of its minimum adenine dinucleotide content. In some embodiments, an mRNA is provided that encodes an RNA-guided DNA-binding agent comprising an open reading frame (ORF) having an adenine dinucleotide content less than or equal to about 145% of its minimum adenine dinucleotide content. In some embodiments, an mRNA is provided that encodes an RNA-guided DNA-binding agent comprising an open reading frame (ORF) having an adenine dinucleotide content less than or equal to about 140% of its minimum adenine dinucleotide content. In some embodiments, an mRNA is provided that encodes an RNA-guided DNA-binding agent comprising an open reading frame (ORF) having an adenine dinucleotide content less than or equal to about 135% of its minimum adenine dinucleotide content. In some embodiments, an mRNA is provided that encodes an RNA-guided DNA-binding agent comprising an open reading frame (ORF) having an adenine dinucleotide content less than or equal to about 130% of its minimum adenine dinucleotide content. In some embodiments, an mRNA is provided that encodes an RNA-guided DNA-binding agent comprising an open reading frame (ORF) having an adenine dinucleotide content less than or equal to about 125% of its minimum adenine dinucleotide content. In some embodiments, an mRNA is provided that encodes an RNA-guided DNA-binding agent comprising an open reading frame (ORF) having an adenine dinucleotide content less than or equal to about 120% of its minimum adenine dinucleotide content. In some embodiments, an mRNA is provided that encodes an RNA-guided DNA-binding agent comprising an open reading frame (ORF) having an adenine dinucleotide content less than or equal to about 115% of its minimum adenine dinucleotide content. In some embodiments, an mRNA is provided that encodes an RNA-guided DNA-binding agent comprising an open reading frame (ORF) having an adenine dinucleotide content less than or equal to about 110% of its minimum adenine dinucleotide content. In some embodiments, an mRNA is provided that encodes an RNA-guided DNA-binding agent comprising an open reading frame (ORF) having an adenine dinucleotide content less than or equal to about 105% of its minimum adenine dinucleotide content. In some embodiments, an mRNA is provided that encodes an RNA-guided DNA-binding agent comprising an open reading frame (ORF) having an adenine dinucleotide content less than or equal to about 104% of its minimum adenine dinucleotide content. In some embodiments, an mRNA is provided that encodes an RNA-guided DNA-binding agent comprising an open reading frame (ORF) having an adenine dinucleotide content less than or equal to about 103% of its minimum adenine dinucleotide content. In some embodiments, an mRNA is provided that encodes an RNA-guided DNA-binding agent comprising an open reading frame (ORF) having an adenine dinucleotide content less than or equal to about 102% of its minimum adenine dinucleotide content. In some embodiments, an mRNA is provided that encodes an RNA-guided DNA-binding agent comprising an open reading frame (ORF) having an adenine dinucleotide content less than or equal to about 101% of its minimum adenine dinucleotide content.

In some embodiments, an mRNA is provided that encodes an RNA-guided DNA-binding agent comprising an open reading frame (ORF) having an adenine dinucleotide content ranging from its minimum adenine dinucleotide content to the adenine dinucleotide content that is 90% or lower of the maximum adenine dinucleotide content of a reference sequence that encodes the same protein as the mRNA in question. In some embodiments, the adenine dinucleotide content of the ORF is less than or equal to about 85%, 80%, 75%, 70%, 65%, 60%, 55%, 50%, 45%, 40%, 35%, 30%, 25%, 20%, 15%, 10%, or 5% of the maximum adenine dinucleotide content of a reference sequence that encodes the same protein as the mRNA in question.

In some embodiments, an mRNA is provided that encodes an RNA-guided DNA-binding agent comprising an open reading frame (ORF) having an adenine trinucleotide content ranging from 0 adenine trinucleotides to 1, 2, 3, 4, 5, 6, 7, 8, 9, 10, 20, 30, 40, or 50 adenine trinucleotides (where a longer run of adenines counts as the number of unique three-adenine segments within it, e.g., an adenine tetranucleotide contains two adenine trinucleotides, an adenine pentanucleotide contains three adenine trinucleotides, etc.). In some embodiments, an mRNA is provided that encodes an RNA-guided DNA-binding agent comprising an open reading frame (ORF) having an adenine trinucleotide content ranging from 0% adenine trinucleotides to 0.1%, 0.2%, 0.3%, 0.4%, 0.5%, 0.6%, 0.7%, 0.8%, 0.9%, 1%, 1.5%, or 2% adenine trinucleotides, where the percentage content of adenine trinucleotides is calculated as the percentage of positions in a sequence that are occupied by adenines that form part of an adenine trinucleotide (or longer run of adenines), such that the sequences UUUAAA and UUUUAAAA would each have an adenine trinucleotide content of 50%. For example, in some embodiments, the ORF has an adenine trinucleotide content less than or equal to 2%. For example, in some embodiments, the ORF has an adenine trinucleotide content less than or equal to 1.5%. In some embodiments, the ORF has an adenine trinucleotide content less than or equal to 1%. In some embodiments, the ORF has an adenine trinucleotide content less than or equal to 0.9%. In some embodiments, the ORF has an adenine trinucleotide content less than or equal to 0.8%. In some embodiments, the ORF has an adenine trinucleotide content less than or equal to 0.7%. In some embodiments, the ORF has an adenine trinucleotide content less than or equal to 0.6%. In some embodiments, the ORF has an adenine trinucleotide content less than or equal to 0.5%. In some embodiments, the ORF has an adenine trinucleotide content less than or equal to 0.4%. In some embodiments, the ORF has an adenine trinucleotide content less than or equal to 0.3%. In some embodiments, the ORF has an adenine trinucleotide content less than or equal to 0.2%. In some embodiments, the ORF has an adenine trinucleotide content less than or equal to 0.1%. In some embodiments, an mRNA is provided that encodes an RNA-guided DNA-binding agent comprising an open reading frame (ORF) containing no adenine trinucleotides.

In some embodiments, an mRNA is provided that encodes an RNA-guided DNA-binding agent comprising an open reading frame (ORF) having minimal nucleotide homopolymers, e.g., repetitive strings of the same nucleotides. For example, in some embodiments, when selecting a minimal adenine codon from the codons listed in Table 1, an mRNA is constructed by selecting the minimal adenine codons that reduce the number and length of nucleotide homopolymers, e.g., selecting GCA instead of GCC for alanine or selecting GGA instead of GGG for glycine or selecting AAG instead of AAA for lysine.

In some embodiments, an mRNA is provided that encodes an RNA-guided DNA-binding agent comprising an open reading frame (ORF) having an adenine trinucleotide content ranging from its minimum adenine trinucleotide content to the adenine trinucleotide content that is 90% or lower of the maximum adenine trinucleotide content of a reference sequence that encodes the same protein as the mRNA in question. In some embodiments, the adenine trinucleotide content of the ORF is less than or equal to about 85%, 80%, 75%, 70%, 65%, 60%, 55%, 50%, 45%, 40%, 35%, 30%, 25%, 20%, 15%, 10%, or 5% of the maximum adenine trinucleotide content of a reference sequence that encodes the same protein as the mRNA in question.

A given ORF can be reduced in adenine content or adenine dinucleotide content or adenine trinucleotide content, for example, by using minimal adenine codons in a sufficient fraction of the ORF. For example, an amino acid sequence for an RNA-guided DNA-binding agent can be back-translated into an ORF sequence by converting amino acids to codons, wherein some or all of the ORF uses the exemplary minimal adenine codons shown below. In some embodiments, at least about 50%, 55%, 60%, 65%, 70%, 75%, 80%, 85%, 90%, 95%, 98%, 99%, or 100% of the codons in the ORF are codons listed in Table 2.

TABLE 2

Exemplary minimal adenine codons

| | Amino Acid | Minimal adenine codon |
|---|---|---|
| A | Alanine | GCU or GCC or GCG |
| G | Glycine | GGU or GGC or GGG |
| V | Valine | GUC or GUU or GUG |
| D | Aspartic acid | GAC or GAU |
| E | Glutamic acid | GAG |
| I | Isoleucine | AUC or AUU |
| T | Threonine | ACU or ACC or ACG |
| N | Asparagine | AAC or AAU |
| K | Lysine | AAG |
| S | Serine | UCU or UCC or UCG |
| R | Arginine | CGU or CGC or CGG |
| L | Leucine | CUG or CUC or CUU |
| P | Proline | CCG or CCU or CCC |
| H | Histidine | CAC or CAU |
| Q | Glutamine | CAG |
| F | Phenylalanine | UUC or UUU |
| Y | Tyrosine | UAC or UAU |
| C | Cysteine | UGC or UGU |
| W | Tryptophan | UGG |
| M | Methionine | AUG |

In some embodiments, an mRNA is provided that encodes an RNA-guided DNA-binding agent comprising an open reading frame (ORF) consisting of a set of codons of which at least about 75%, 80%, 85%, 90%, 95%, 98%, 99%, or 100% of the codons are codons listed in Table 2.

3. mRNAs and ORFs with Low Adenine and Low Uridine Content

To the extent feasible, any of the features described above with respect to low adenine content can be combined with any of the features described above with respect to low uridine content. For example, an mRNA may be provided that encodes an RNA-guided DNA-binding agent comprising an open reading frame (ORF) having a uridine content ranging from its minimum uridine content to about 150% of its minimum uridine content (e.g., a uridine content of the ORF is less than or equal to about 145%, 140%, 135%, 130%, 125%, 120%, 115%, 110%, 105%, 104%, 103%, 102%, or 101% of its minimum uridine content) and an adenine content ranging from its minimum adenine content to about 150% of its minimum adenine content (e.g., less than or equal to about 145%, 140%, 135%, 130%, 125%, 120%, 115%, 110%, 105%, 104%, 103%, 102%, or 101% of its minimum adenine content). So too for uridine and adenine dinucleotides. Similarly, the content of uridine nucleotides and adenine dinucleotides in the ORF may be as set forth above. Similarly, the content of uridine dinucleotides and adenine nucleotides in the ORF may be as set forth above.

A given ORF can be reduced in uridine and adenine nucleotide and/or dinucleotide content, for example, by using minimal uridine and adenine codons in a sufficient fraction of the ORF. For example, an amino acid sequence for an RNA-guided DNA-binding agent can be back-translated into an ORF sequence by converting amino acids to codons, wherein some or all of the ORF uses the exemplary minimal uridine and adenine codons shown below. In some embodiments, at least about 50%, 55%, 60%, 65%, 70%, 75%, 80%, 85%, 90%, 95%, 98%, 99%, or 100% of the codons in the ORF are codons listed in Table 3.

TABLE 3

Exemplary minimal uridine and adenine codons

| | Amino Acid | Minimal uridine codon |
|---|---|---|
| A | Alanine | GCC or GCG |
| G | Glycine | GGC or GGG |
| V | Valine | GUC or GUG |
| D | Aspartic acid | GAC |
| E | Glutamic acid | GAG |
| I | Isoleucine | AUC |
| T | Threonine | ACC or ACG |
| N | Asparagine | AAC |
| K | Lysine | AAG |
| S | Serine | AGC or UCC or UCG |
| R | Arginine | CGC or CGG |
| L | Leucine | CUG or CUC |
| P | Proline | CCG or CCC |
| H | Histidine | CAC |
| Q | Glutamine | CAG |
| F | Phenylalanine | UUC |
| Y | Tyrosine | UAC |
| C | Cysteine | UGC |
| W | Tryptophan | UGG |
| M | Methionine | AUG |

In some embodiments, an mRNA is provided that encodes an RNA-guided DNA-binding agent comprising an open reading frame (ORF) consisting of a set of codons of which at least about 75%, 80%, 85%, 90%, 95%, 98%, 99%, or 100% of the codons are codons listed in Table 3. As can be seen in Table 3, each of the three listed serine codons contains either one A or one U. In some embodiments, uridine minimization is prioritized by using AGC codons for serine. In some embodiments, adenine minimization is prioritized by using UCC and/or UCG codons for serine.

4. Codons that Increase Translation and/or that Correspond to Highly Expressed tRNAs; Exemplary Codon Sets In some embodiments, the mRNA comprises an ORF having codons that increase translation in a mammal, such as a human. In further embodiments, the mRNA comprises an ORF having codons that increase translation in an organ, such as the liver, of the mammal, e.g., a human. In further embodiments, the mRNA comprises an ORF having codons that increase translation in a cell type, such as a hepatocyte, of the mammal, e.g., a human. An increase in translation in a mammal, cell type, organ of a mammal, human, organ of a human, etc., can be determined relative to the extent of translation wild-type sequence of the ORF, or relative to an ORF having a codon distribution matching the codon distribution of the organism from which the ORF was derived or the organism that contains the most similar ORF at the amino acid level, such as S. pyogenes, S. aureus, or another prokaryote as the case may be for prokaryotically-derived Cas nucleases, such as the Cas nucleases from other prokaryotes described below. Alternatively, in some embodiments, an increase in translation for a Cas9 sequence in a mammal, cell type, organ of a mammal, human, organ of a human, etc., is determined relative to translation of an ORF with the sequence of SEQ ID NO: 5 with all else equal, including any applicable point mutations, heterologous domains, and the like. Codons useful for increasing expression in a human, including the human liver and human hepatocytes, can be codons corresponding to highly expressed tRNAs in the human liver/hepatocytes, which are discussed in Dittmar K A, PLos Genetics 2(12): e221 (2006). In some embodiments, at least about 75%, 80%, 85%, 90%, 95%, 96%, 97%, 98%, 99%, or 100% of the codons in an ORF are codons corresponding to highly expressed tRNAs (e.g., the highest-expressed tRNA for each amino acid) in a mammal, such as a human. In some embodiments, at least 75%, 80%, 85%, 90%, 95%, 96%, 97%, 98%, 99%, or 100% of the codons in an ORF are codons corresponding to highly expressed tRNAs (e.g., the highest-expressed tRNA for each amino acid) in a mammalian organ, such as a human organ. In some embodiments, at least 75%, 80%, 85%, 90%, 95%, 96%, 97%, 98%, 99%, or 100% of the codons in an ORF are codons corresponding to highly expressed tRNAs (e.g., the highest-expressed tRNA for each amino acid) in a mammalian liver, such as a human liver. In some embodiments, at least 75%, 80%, 85%, 90%, 95%, 96%, 97%, 98%, 99%, or 100% of the codons in an ORF are codons corresponding to highly expressed tRNAs (e.g., the highest-expressed tRNA for each amino acid) in a mammalian hepatocyte, such as a human hepatocyte.

Alternatively, codons corresponding to highly expressed tRNAs in an organism (e.g., human) in general may be used.

Any of the foregoing approaches to codon selection can be combined with the minimal uridine and/or adenine codons shown above, e.g., by starting with the codons of Table 1, 2, or 3, and then where more than one option is available, using the codon that corresponds to a more highly-expressed tRNA, either in the organism (e.g., human) in general, or in an organ or cell type of interest, such as the liver or hepatocytes (e.g., human liver or human hepatocytes).

In some embodiments, at least 75%, 80%, 85%, 90%, 95%, 96%, 97%, 98%, 99%, or 100% of the codons in an ORF are codons from a codon set shown in Table 4 (e.g., the low U 1, low A, or low A/U codon set). The codons in the low U 1, low G, low C, low A, and low A/U sets use codons that minimize the indicated nucleotides while also using codons corresponding to highly expressed tRNAs where more than one option is available. In some embodiments, at least 75%, 80%, 85%, 90%, 95%, 96%, 97%, 98%, 99%, or 100% of the codons in an ORF are codons from the low U 1 codon set shown in Table 4. In some embodiments, at least 75%, 80%, 85%, 90%, 95%, 96%, 97%, 98%, 99%, or 100% of the codons in an ORF are codons from the low A codon set shown in Table 4. In some embodiments, at least 75%, 80%, 85%, 90%, 95%, 96%, 97%, 98%, 99%, or 100% of the codons in an ORF are codons from the low A/U codon set shown in Table 4.

TABLE 4

Exemplary Codon Sets.

| Amino Acid | Low U 1 | Low U 2 | High U | Low G | Low C | Low A | Low A/U | Long Half Life |
|---|---|---|---|---|---|---|---|---|
| Gly | GGC | GGG | GGT | GGC | GGA | GGC | GGC | GGT |
| Glu | GAG | GAA | GAA | GAA | GAG | GAG | GAG | GAA |
| Asp | GAC | GAC | GAT | GAC | GAT | GAC | GAC | GAC |
| Val | GTG | GTA | GTT | GTC | GTG | GTG | GTG | GTC |
| Ala | GCC | GCG | GCT | GCC | GCT | GCC | GCC | GCC |
| Arg | AGA | CGA | CGT | AGA | AGA | CGG | CGG | AGA |
| Ser | AGC | AGC | TCT | TCC | AGT | TCC | AGC | TCT |
| Lys | AAG | AAA | AAA | AAA | AAG | AAG | AAG | AAG |
| Asn | AAC | AAC | AAT | AAC | AAT | AAC | AAC | AAC |
| Met | ATG | ATG | ATG | ATG | AGT | ATG | ATG | ATG |

TABLE 4-continued

Exemplary Codon Sets.

| Amino Acid | Low U 1 | Low U 2 | High U | Low G | Low C | Low A | Low A/U | Long Half Life |
|---|---|---|---|---|---|---|---|---|
| Ile | ATC | ATA | ATT | ATC | ATT | ATC | ATC | ATC |
| Thr | ACC | ACG | ACT | ACC | ACA | ACC | ACC | ACC |
| Trp | TGG | TGG | TGG | TGG | TGG | TGG | TGG | TGG |
| Cys | TGC | TGC | TGT | TGC | TGT | TGC | TGC | TGC |
| Tyr | TAC | TAC | TAT | TAC | TAT | TAC | TAC | TAC |
| Leu | CTG | CTA | TTA | CTC | TTG | CTG | CTG | TTG |
| Phe | TTC | TTC | TTT | TTC | TTT | TTC | TTC | TTC |
| Gln | CAG | CAA | CAA | CAA | CAG | CAG | CAG | CAA |
| His | CAC | CAC | CAT | CAC | CAT | CAC | CAC | CAC |

5. Encoded RNA-Guided DNA Binding Agent

In some embodiments, the RNA-guided DNA-binding agent is a Class 2 Cas nuclease. In some embodiments, the RNA-guided DNA-binding agent has cleavase activity, which can also be referred to as double-strand endonuclease activity. In some embodiments, the RNA-guided DNA-binding agent comprises a Cas nuclease, such as a Class 2 Cas nuclease (which may be, e.g., a Cas nuclease of Type II, V, or VI). Class 2 Cas nucleases include, for example, Cas9, Cpf1, C2c1, C2c2, and C2c3 proteins and modifications thereof. Examples of Cas9 nucleases include those of the type II CRISPR systems of S. pyogenes, S. aureus, and other prokaryotes (see, e.g., the list in the next paragraph), and modified (e.g., engineered or mutant) versions thereof. See, e.g., US2016/0312198 A1; US 2016/0312199 A1. Other examples of Cas nucleases include a Csm or Cmr complex of a type III CRISPR system or the Cas10, Csm1, or Cmr2 subunit thereof, and a Cascade complex of a type I CRISPR system, or the Cas3 subunit thereof. In some embodiments, the Cas nuclease may be from a Type-IIA, Type-IIB, or Type-IIC system. For discussion of various CRISPR systems and Cas nucleases see, e.g., Makarova et al., NAT. REV. MICROBIOL. 9:467-477 (2011); Makarova et al., NAT. REV. MICROBIOL, 13: 722-36 (2015); Shmakov et al., MOLECULAR CELL, 60:385-397 (2015).

Non-limiting exemplary species that the Cas nuclease can be derived from include Streptococcus pyogenes, Streptococcus thermophilus, Streptococcus sp., Staphylococcus aureus, Listeria innocua, Lactobacillus gasseri, Francisella novicida, Wolinella succinogenes, Sutterella wadsworthensis, Gammaproteobacterium, Neisseria meningitidis, Campylobacter jejuni, Pasteurella multocida, Fibrobacter succinogene, Rhodospirillum rubrum, Nocardiopsis dassonvillei, Streptomyces pristinaespiralis, Streptomyces viridochromogenes, Streptomyces viridochromogenes, Streptosporangium roseum, Streptosporangium roseum, Alicyclobacillus acidocaldarius, Bacillus pseudomycoides, Bacillus selenitireducens, Exiguobacterium sibiricum, Lactobacillus delbrueckii, Lactobacillus salivarius, Lactobacillus buchneri, Treponema denticola, Microscilla marina, Burkholderiales bacterium, Polaromonas naphthalenivorans, Polaromonas sp., Crocosphaera watsonii, Cyanothece sp., Microcystis aeruginosa, Synechococcus sp., Acetohalobium arabaticum, Ammonifex degensii, Caldicelulosiruptor becscii, Candidatus Desulforudis, Clostridium botulinum, Clostridium difficile, Finegoldia magna, Natranaerobius thermophilus, Pelotomaculum thermopropionicum, Acidithiobacillus caldus, Acidithiobacillus ferrooxidans, Allochromatium vinosum, Marinobacter sp., Nitrosococcus halophilus, Nitrosococcus watsoni, Pseudoalteromonas haloplanktis, Ktedonobacter racemifer, Methanohalobium evestigatum, Anabaena variabilis, Nodularia spumigena, Nostoc sp., Arthrospira maxima, Arthrospira platensis, Arthrospira sp., Lyngbya sp., Microcoleus chthonoplastes, Oscillatoria sp., Petrotoga mobilis, Thermosipho africanus, Streptococcus pasteurianus, Neisseria cinerea, Campylobacter lari, Parvibaculum lavamentivorans, Corynebacterium diphtheria, Acidaminococcus sp., Lachnospiraceae bacterium ND2006, and Acaryochloris marina.

In some embodiments, the Cas nuclease is the Cas9 nuclease from Streptococcus pyogenes. In some embodiments, the Cas nuclease is the Cas9 nuclease from Streptococcus thermophilus. In some embodiments, the Cas nuclease is the Cas9 nuclease from Neisseria meningitidis. In some embodiments, the Cas nuclease is the Cas9 nuclease is from Staphylococcus aureus. In some embodiments, the Cas nuclease is the Cpf1 nuclease from Francisella novicida. In some embodiments, the Cas nuclease is the Cpf1 nuclease from Acidaminococcus sp. In some embodiments, the Cas nuclease is the Cpf1 nuclease from Lachnospiraceae bacterium ND2006. In further embodiments, the Cas nuclease is the Cpf1 nuclease from Francisella tularensis, Lachnospiraceae bacterium, Butyrivibrio proteoclasticus, Peregrinibacteria bacterium, Parcubacteria bacterium, Smithella, Acidaminococcus, Candidatus Methanoplasma termitum, Eubacterium eligens, Moraxella bovoculi, Leptospira inadai, Porphyromonas crevioricanis, Prevotella disiens, or Porphyromonas macacae. In certain embodiments, the Cas nuclease is a Cpf1 nuclease from an Acidaminococcus or Lachnospiraceae.

Wild type Cas9 has two nuclease domains: RuvC and HNH. The RuvC domain cleaves the non-target DNA strand, and the HNH domain cleaves the target strand of DNA. In some embodiments, the Cas9 nuclease comprises more than one RuvC domain and/or more than one HNH domain. In some embodiments, the Cas9 nuclease is a wild type Cas9. In some embodiments, the Cas9 is capable of inducing a double strand break in target DNA. In certain embodiments, the Cas nuclease may cleave dsDNA, it may cleave one strand of dsDNA, or it may not have DNA cleavase or nickase activity. An exemplary Cas9 amino acid sequence is provided as SEQ ID NO: 3. An exemplary Cas9 mRNA ORF sequence, which includes start and stop codons, is provided as SEQ ID NO: 4. An exemplary Cas9 mRNA coding sequence, suitable for inclusion in a fusion protein, is provided as SEQ ID NO: 10.

In some embodiments, chimeric Cas nucleases are used, where one domain or region of the protein is replaced by a portion of a different protein. In some embodiments, a Cas nuclease domain may be replaced with a domain from a different nuclease such as FokL. In some embodiments, a Cas nuclease may be a modified nuclease.

In other embodiments, the Cas nuclease may be from a Type-I CRISPR/Cas system. In some embodiments, the Cas nuclease may be a component of the Cascade complex of a Type-I CRISPR/Cas system. In some embodiments, the Cas nuclease may be a Cas3 protein. In some embodiments, the Cas nuclease may be from a Type-III CRISPR/Cas system. In some embodiments, the Cas nuclease may have an RNA cleavage activity.

In some embodiments, the RNA-guided DNA-binding agent has single-strand nickase activity, i.e., can cut one DNA strand to produce a single-strand break, also known as a "nick." In some embodiments, the RNA-guided DNA-binding agent comprises a Cas nickase. A nickase is an enzyme that creates a nick in dsDNA, i.e., cuts one strand but not the other of the DNA double helix. In some embodiments, a Cas nickase is a version of a Cas nuclease (e.g., a Cas nuclease discussed above) in which an endonucleolytic active site is inactivated, e.g., by one or more alterations (e.g., point mutations) in a catalytic domain. See, e.g., U.S. Pat. No. 8,889,356 for discussion of Cas nickases and exemplary catalytic domain alterations. In some embodiments, a Cas nickase such as a Cas9 nickase has an inactivated RuvC or HNH domain. An exemplary Cas9 nickase amino acid sequence is provided as SEQ ID NO: 6. An exemplary Cas9 nickase mRNA ORF sequence, which includes start and stop codons, is provided as SEQ ID NO: 7. An exemplary Cas9 nickase mRNA coding sequence, suitable for inclusion in a fusion protein, is provided as SEQ ID NO: 11.

In some embodiments, the RNA-guided DNA-binding agent is modified to contain only one functional nuclease domain. For example, the agent protein may be modified such that one of the nuclease domains is mutated or fully or partially deleted to reduce its nucleic acid cleavage activity. In some embodiments, a nickase is used having a RuvC domain with reduced activity. In some embodiments, a nickase is used having an inactive RuvC domain. In some embodiments, a nickase is used having an HNH domain with reduced activity. In some embodiments, a nickase is used having an inactive HNH domain.

In some embodiments, a conserved amino acid within a Cas protein nuclease domain is substituted to reduce or alter nuclease activity. In some embodiments, a Cas nuclease may comprise an amino acid substitution in the RuvC or RuvC-like nuclease domain. Exemplary amino acid substitutions in the RuvC or RuvC-like nuclease domain include D10A (based on the *S. pyogenes* Cas9 protein). See, e.g., Zetsche et al. (2015) *Cell* Oct 22:163(3): 759-771. In some embodiments, the Cas nuclease may comprise an amino acid substitution in the HNH or HNH-like nuclease domain. Exemplary amino acid substitutions in the HNH or HNH-like nuclease domain include E762A, H840A, N863A, H983A, and D986A (based on the *S. pyogenes* Cas9 protein). See, e.g., Zetsche et al. (2015). Further exemplary amino acid substitutions include D917A, E1006A, and D1255A (based on the *Francisella novicida* U112 Cpf1 (FnCpf1) sequence (UniProtKB—A0Q7Q2 (CPF1_FRATN)).

In some embodiments, an mRNA encoding a nickase is provided in combination with a pair of guide RNAs that are complementary to the sense and antisense strands of the target sequence, respectively. In this embodiment, the guide RNAs direct the nickase to a target sequence and introduce a DSB by generating a nick on opposite strands of the target sequence (i.e., double nicking). In some embodiments, use of double nicking may improve specificity and reduce off-target effects. In some embodiments, a nickase is used together with two separate guide RNAs targeting opposite strands of DNA to produce a double nick in the target DNA. In some embodiments, a nickase is used together with two separate guide RNAs that are selected to be in close proximity to produce a double nick in the target DNA.

In some embodiments, the RNA-guided DNA-binding agent lacks cleavage and nickase activity. In some embodiments, the RNA-guided DNA-binding agent comprises a dCas DNA-binding polypeptide. A dCas polypeptide has DNA-binding activity while essentially lacking catalytic (cleavase/nickase) activity. In some embodiments, the dCas polypeptide is a dCas9 polypeptide. In some embodiments, the RNA-guided DNA-binding agent lacking cleavase and nickase activity or the dCas DNA-binding polypeptide is a version of a Cas nuclease (e.g., a Cas nuclease discussed above) in which its endonucleolytic active sites are inactivated, e.g., by one or more alterations (e.g., point mutations) in its catalytic domains. See, e.g., US 2014/0186958 A1; US 2015/0166980 A1. An exemplary dCas9 amino acid sequence is provided as SEQ ID NO: 8. An exemplary dCas9 mRNA ORF sequence, which includes start and stop codons, is provided as SEQ ID NO: 9. An exemplary dCas9 mRNA coding sequence, suitable for inclusion in a fusion protein, is provided as SEQ ID NO: 12.

6. Heterologous Functional Domains; Nuclear Localization Signals

In some embodiments, the RNA-guided DNA-binding agent comprises one or more heterologous functional domains (e.g., is or comprises a fusion polypeptide).

In some embodiments, the heterologous functional domain may facilitate transport of the RNA-guided DNA-binding agent into the nucleus of a cell. For example, the heterologous functional domain may be a nuclear localization signal (NLS). In some embodiments, the RNA-guided DNA-binding agent may be fused with 1-10 NLS(s). In some embodiments, the RNA-guided DNA-binding agent may be fused with 1-5 NLS(s). In some embodiments, the RNA-guided DNA-binding agent may be fused with one NLS. Where one NLS is used, the NLS may be linked at the N-terminus or the C-terminus of the RNA-guided DNA-binding agent sequence. In some embodiments, the RNA-guided DNA-binding agent may be fused C-terminally to at least one NLS. An NLS may also be inserted within the RNA-guided DNA binding agent sequence. In other embodiments, the RNA-guided DNA-binding agent may be fused with more than one NLS. In some embodiments, the RNA-guided DNA-binding agent may be fused with 2, 3, 4, or 5 NLSs. In some embodiments, the RNA-guided DNA-binding agent may be fused with two NLSs. In certain circumstances, the two NLSs may be the same (e.g., two SV40 NLSs) or different. In some embodiments, the RNA-guided DNA-binding agent is fused to two SV40 NLS sequences linked at the carboxy terminus. In some embodiments, the RNA-guided DNA-binding agent may be fused with two NLSs, one linked at the N-terminus and one at the C-terminus. In some embodiments, the RNA-guided DNA-binding agent may be fused with 3 NLSs. In some embodiments, the RNA-guided DNA-binding agent may be fused with no NLS. In some embodiments, the NLS may be a monopartite sequence, such as, e.g., the SV40 NLS, PKKKRKV (SEQ ID NO: 78) or PKKKRRV (SEQ ID NO: 90). In some embodiments, the NLS may be a bipartite sequence, such as the NLS of nucleoplasmin, KRPAATKKAGQAKKKK (SEQ ID NO: 91). In some embodiments, the NLS sequence may comprise LAAKRSRTT (SEQ ID NO: 79), QAAKRSRTT (SEQ ID NO: 80), PAPAKRERTT (SEQ ID NO: 81), QAAKRPRTT (SEQ ID NO: 82), RAAKRPRTT (SEQ ID NO: 83), AAAKRSWSMAA (SEQ ID NO: 84), AAAKRVWSMAF (SEQ ID NO: 85), AAAKRSWSMAF (SEQ ID NO: 86), AAAKRKYFAA (SEQ ID NO: 87), RAAKRKAFAA (SEQ ID NO: 88), or RAAKRKYFAV (SEQ ID NO: 89). In a specific embodiment, a single PKKKRKV (SEQ ID NO: 78) NLS may be linked at the C-terminus of the RNA-guided DNA-binding agent. One or more linkers are optionally included at the fusion site. In some embodiments, one or more NLS(s) according to any of the foregoing embodiments are present in the RNA-guided DNA-binding agent in combination with one or more additional heterologous functional domains, such as any of the heterologous functional domains described below.

In some embodiments, the heterologous functional domain may be capable of modifying the intracellular half-life of the RNA-guided DNA binding agent. In some embodiments, the half-life of the RNA-guided DNA binding agent may be increased. In some embodiments, the half-life of the RNA-guided DNA-binding agent may be reduced. In some embodiments, the heterologous functional domain may be capable of increasing the stability of the RNA-guided DNA-binding agent. In some embodiments, the heterologous functional domain may be capable of reducing the stability of the RNA-guided DNA-binding agent. In some embodiments, the heterologous functional domain may act as a signal peptide for protein degradation. In some embodiments, the protein degradation may be mediated by proteolytic enzymes, such as, for example, proteasomes, lysosomal proteases, or calpain proteases. In some embodiments, the heterologous functional domain may comprise a PEST sequence. In some embodiments, the RNA-guided DNA-binding agent may be modified by addition of ubiquitin or a polyubiquitin chain. In some embodiments, the ubiquitin may be a ubiquitin-like protein (UBL). Non-limiting examples of ubiquitin-like proteins include small ubiquitin-like modifier (SUMO), ubiquitin cross-reactive protein (UCRP, also known as interferon-stimulated gene-15 (ISG15)), ubiquitin-related modifier-1 (URM1), neuronal-precursor-cell-expressed developmentally downregulated protein-8 (NEDD8, also called Rub1 in *S. cerevisiae*), human leukocyte antigen F-associated (FAT10), autophagy-8 (ATG8) and -12 (ATG12), Fau ubiquitin-like protein (FUBI), membrane-anchored UBL (MUB), ubiquitin fold-modifier-1 (UFM1), and ubiquitin-like protein-5 (UBL5).

In some embodiments, the heterologous functional domain may be a marker domain. Non-limiting examples of marker domains include fluorescent proteins, purification tags, epitope tags, and reporter gene sequences. In some embodiments, the marker domain may be a fluorescent protein. Non-limiting examples of suitable fluorescent proteins include green fluorescent proteins (e.g., GFP, GFP-2, tagGFP, turboGFP, sfGFP, EGFP, Emerald, Azami Green, Monomeric Azami Green, CopGFP, AceGFP, ZsGreen1), yellow fluorescent proteins (e.g., YFP, EYFP, Citrine, Venus, YPet, PhiYFP, ZsYellow1), blue fluorescent proteins (e.g., EBFP, EBFP2, Azurite, mKalama1, GFPuv, Sapphire, T-sapphire), cyan fluorescent proteins (e.g., ECFP, Cerulean, CyPet, AmCyan1, Midoriishi-Cyan), red fluorescent proteins (e.g., mKate, mKate2, mPlum, DsRed monomer, mCherry, mRFP1, DsRed-Express, DsRed2, DsRed-Monomer, HcRed-Tandem, HcRed1, AsRed2, eqFP611, mRaspberry, mStrawberry, Jred), and orange fluorescent proteins (mOrange, mKO, Kusabira-Orange, Monomeric Kusabira-Orange, mTangerine, tdTomato) or any other suitable fluorescent protein. In other embodiments, the marker domain may be a purification tag and/or an epitope tag. Non-limiting exemplary tags include glutathione-S-transferase (GST), chitin binding protein (CBP), maltose binding protein (MBP), thioredoxin (TRX), poly(NANP), tandem affinity purification (TAP) tag, myc, AcV5, AU1, AU5, E, ECS, E2, FLAG, HA, nus, Softag 1, Softag 3, Strep, SBP, Glu-Glu, HSV, KT3, S, S1, T7, V5, VSV-G, 6×His, 8×His, biotin carboxyl carrier protein (BCCP), poly-His, and calmodulin. Non-limiting exemplary reporter genes include glutathione-S-transferase (GST), horseradish peroxidase (HRP), chloramphenicol acetyltransferase (CAT), beta-galactosidase, beta-glucuronidase, luciferase, or fluorescent proteins.

In additional embodiments, the heterologous functional domain may target the RNA-guided DNA-binding agent to a specific organelle, cell type, tissue, or organ. In some embodiments, the heterologous functional domain may target the RNA-guided DNA-binding agent to mitochondria.

In further embodiments, the heterologous functional domain may be an effector domain. When the RNA-guided DNA-binding agent is directed to its target sequence, e.g., when a Cas nuclease is directed to a target sequence by a gRNA, the effector domain may modify or affect the target sequence. In some embodiments, the effector domain may be chosen from a nucleic acid binding domain, a nuclease domain (e.g., a non-Cas nuclease domain), an epigenetic modification domain, a transcriptional activation domain, or a transcriptional repressor domain. In some embodiments, the heterologous functional domain is a nuclease, such as a FokI nuclease. See, e.g., U.S. Pat. No. 9,023,649. In some embodiments, the heterologous functional domain is a transcriptional activator or repressor. See, e.g., Qi et al., "Repurposing CRISPR as an RNA-guided platform for sequence-specific control of gene expression," *Cell* 1.52:1173-83 (2013); Perez-Pinera et al., "RNA-guided gene activation by CRISPR-Cas9-based transcription factors," *Nat. Methods* 10:973-6 (2013); Mali et al., "CAS9 transcriptional activators for target specificity screening and paired nickases for cooperative genome engineering," *Nat. Biotechnol.* 31:833-8 (2013); Gilbert et al., "CRISPR-mediated modular RNA-guided regulation of transcription in eukaryotes," *Cell* 154:442-51 (2013). As such, the RNA-guided DNA-binding agent essentially becomes a transcription factor that can be directed to bind a desired target sequence using a guide RNA. In certain embodiments, the DNA modification domain is a methylation domain, such as a demethylation or methyltransferase domain. In certain embodiments, the effector domain is a DNA modification domain, such as a base-editing domain. In particular embodiments, the DNA modification domain is a nucleic acid editing domain that introduces a specific modification into the DNA, such as a deaminase domain. See, e.g., WO 2015/089406; US 2016/0304846. The nucleic acid editing domains, deaminase domains, and Cas9 variants described in WO 2015/089406 and US 2016/0304846 are hereby incorporated by reference.

7. UTRs; Kozak Sequences

In some embodiments, the mRNA comprises at least one UTR from Hydroxysteroid 17-Beta Dehydrogenase 4 (HSD17B4 or HSD), e.g., a 5' UTR from HSD. In some embodiments, the mRNA comprises at least one UTR from a globin mRNA, for example, human alpha globin (HBA) mRNA, human beta globin (HBB) mRNA, or *Xenopus laevis* beta globin (XBG) mRNA. In some embodiments, the mRNA comprises a 5' UTR, 3' UTR, or 5' and 3' UTRs from a globin mRNA, such as HBA, HBB, or XBG. In some embodiments, the mRNA comprises a 5' UTR from bovine growth hormone, cytomegalovirus (CMV), mouse Hba-al, HSD, an albumin gene, HBA, HBB, or XBG. In some embodiments, the mRNA comprises a 3' UTR from bovine growth hormone, cytomegalovirus, mouse Hba-al, HSD, an albumin gene, HBA, HBB, or XBG. In some embodiments, the mRNA comprises 5' and 3' UTRs from bovine growth hormone, cytomegalovirus, mouse Hba-al, HSD, an albumin gene, HBA, HBB, XBG, heat shock protein 90 (Hsp90), glyceraldehyde 3-phosphate dehydrogenase (GAPDH), beta-actin, alpha-tubulin, tumor protein (p53), or epidermal growth factor receptor (EGFR).

In some embodiments, the mRNA comprises 5' and 3' UTRs that are from the same source, e.g., a constitutively expressed mRNA such as actin, albumin, or a globin such as HBA, HBB, or XBG.

In some embodiments, an mRNA disclosed herein comprises a 5' UTR with at least 90% identity to any one of SEQ ID NOs: 32, 34, 36, 38, or 41. In some embodiments, an mRNA disclosed herein comprises a 3' UTR with at least 90% identity to any one of SEQ ID NOs: 33, 35, 37, 39, or 40. In some embodiments, any of the foregoing levels of identity is at least 95%, at least 98%, at least 99%, or 100%. In some embodiments, an mRNA disclosed herein comprises a 5' UTR having the sequence of any one of SEQ ID NOs: 32, 34, 36, 38, or 41. In some embodiments, an mRNA disclosed herein comprises a 3' UTR having the sequence of any one of SEQ ID NOs: 33, 35, 37, 39, or 40.

In some embodiments, the mRNA does not comprise a 5' UTR, e.g., there are no additional nucleotides between the 5' cap and the start codon. In some embodiments, the mRNA comprises a Kozak sequence (described below) between the 5' cap and the start codon, but does not have any additional 5' UTR. In some embodiments, the mRNA does not comprise a 3' UTR, e.g., there are no additional nucleotides between the stop codon and the poly-A tail.

In some embodiments, the mRNA comprises a Kozak sequence. The Kozak sequence can affect translation initiation and the overall yield of a polypeptide translated from an mRNA. A Kozak sequence includes a methionine codon that can function as the start codon. A minimal Kozak sequence is NNNRUGN wherein at least one of the following is true: the first N is A or G and the second N is G. In the context of a nucleotide sequence, R means a purine (A or G). In some embodiments, the Kozak sequence is RNNRUGN, NNNRUGG, RNNRUGG, RNNAUGN, NNNAUGG, or RNNAUGG. In some embodiments, the Kozak sequence is rccRUGg with zero mismatches or with up to one or two mismatches to positions in lowercase. In some embodiments, the Kozak sequence is rccAUGg with zero mismatches or with up to one or two mismatches to positions in lowercase. In some embodiments, the Kozak sequence is gccRccAUGG (nucleotides 4-13 of SEQ ID NO: 105) with zero mismatches or with up to one, two, or three mismatches to positions in lowercase. In some embodiments, the Kozak sequence is gccAccAUG with zero mismatches or with up to one, two, three, or four mismatches to positions in lowercase. In some embodiments, the Kozak sequence is GCCACCAUG. In some embodiments, the Kozak sequence is gccgccRccAUGG (SEQ ID NO: 105) with zero mismatches or with up to one, two, three, or four mismatches to positions in lowercase.

8. Exemplary Sequences

In some embodiments, the mRNA comprises an ORF encoding an RNA-guided DNA binding agent, wherein the ORF comprises a sequence with at least 90% identity to any one of SEQ ID NOs: 1, 4, 7, 9, 10, 11, 12, 14, 15, 17, 18, 20, 21, 23, 24, 26, 27, 29, 30, 50, 52, 54, 65, 66, or 107-175. In some embodiments, the mRNA comprises an ORF encoding an RNA-guided DNA binding agent, wherein the RNA-guided DNA binding agent comprises an amino acid sequence with at least 90% identity to any one of SEQ ID NOs: 3, 6, 8, 13, 16, 19, 22, 25, 28, 68, or 186-196, wherein the ORF has a uridine content ranging from its minimum uridine content to 150% of the minimum uridine content, and/or has a uridine dinucleotide content ranging from its minimum uridine dinucleotide content to 150% of the minimum uridine dinucleotide content. In some embodiments, the mRNA comprises an ORF encoding an RNA-guided DNA binding agent, wherein the RNA-guided DNA binding agent comprises an amino acid sequence with at least 90% identity to any one of SEQ ID NOs: 3, 6, 8, 13, 16, 19, 22, 25, 28, 68, or 186-196, wherein the ORF has an adenine content ranging from its minimum adenine content to 150% of the minimum adenine content, and/or has a adenine dinucleotide content ranging from its minimum adenine dinucleotide content to 150% of the minimum adenine dinucleotide content. In some such embodiments, both the adenine and uridine nucleotide contents are less than or equal to 150% of their respective minima. In some embodiments, both the adenine and uridine dinucleotide contents are less than or equal to 150% of their respective minima. In some embodiments, the mRNA comprises a sequence with at least 90% identity to any one of SEQ ID NOs: 43, 44, 51, 53, 55-61, or 67, wherein the sequence comprises an ORF encoding an RNA-guided DNA binding agent. In some embodiments, the mRNA comprises a sequence with at least 90% identity to any one of SEQ ID NOs: 43, 44, 51, 53, 55-61, or 67, wherein the sequence comprises an ORF encoding an RNA-guided DNA binding agent, wherein the first three nucleotides of SEQ ID NOs: 43, 44, 51, 53, 55-61, or 67 are omitted. In some embodiments, any of the foregoing levels of identity is at least 95%, at least 98%, at least 99%, or 100%.

In some embodiments, the mRNA comprises an ORF encoding an RNA-guided DNA binding agent, wherein the ORF has at least 90% identity to any one of SEQ ID NO: 1, 4, 7, 9, 10, 11, 12, 14, 15, 17, 18, 20, 21, 23, 24, 26, 27, 29, 30, 50, 52, 54, 65, 66, or 107-175 over at least its first 30, 50, 70, 100, 150, 200, 250, or 300 nucleotides. The first 30, 50, 70, 100, 150, 200, 250, or 300 nucleotides are measured from the first nucleotide of the start codon (typically ATG), such that the A is nucleotide 1, the T is nucleotide 2, etc. In some embodiments, the open reading frame has at least 90% identity to any one of SEQ ID NO: 1, 4, 7, 9, 10, 11, 12, 14, 15, 17, 18, 20, 21, 23, 24, 26, 27, 29, 30, 50, 52, 54, 65, 66, or 107-175 over at least its first 10%, 12%, 15%, 20%, 25%, 30%, or 35% of its sequence. The length of the sequence of the ORF is the number of nucleotides from the beginning of the start codon to the end of the stop codon, and the first 10%, 12%, 15%, 20%, 25%, 30%, or 35% of its sequence corresponds to the number of nucleotides starting from the first nucleotide of the start codon that make up the indicated percentage of the length of the total sequence.

In some embodiments, the mRNA comprising an ORF encoding an RNA-guided DNA binding agent comprises a sequence having at least 90% identity to SEQ ID NO: 43, optionally wherein the ORF of SEQ ID NO: 43 (i.e., SEQ ID NO: 4) is substituted with an alternative ORF of any one of SEQ ID NO: 7, 9, 10, 11, 12, 14, 15, 17, 18, 20, 21, 23, 24, 26, 27, 29, 30, 50, 52, 54, 65, 66, or 107-175.

In some embodiments, the mRNA comprising an ORF encoding an RNA-guided DNA binding agent comprises a sequence having at least 90% identity to SEQ ID NO: 44, optionally wherein the ORF of SEQ ID NO: 44 (i.e., SEQ ID NO: 4) is substituted with an alternative ORF of any one of SEQ ID NO: 7, 9, 10, 11, 12, 14, 15, 17, 18, 20, 21, 23, 24, 26, 27, 29, 30, 50, 52, 54, 65, 66, or 107-175.

In some embodiments, the mRNA comprising an ORF encoding an RNA-guided DNA binding agent comprises a sequence having at least 90% identity to SEQ ID NO: 56, optionally wherein the ORF of SEQ ID NO: 56 (i.e., SEQ ID NO: 4) is substituted with an alternative ORF of any one of SEQ ID NO: 7, 9, 10, 11, 12, 14, 15, 17, 18, 20, 21, 23, 24, 26, 27, 29, 30, 50, 52, 54, 65, 66, or 107-175.

In some embodiments, the mRNA comprising an ORF encoding an RNA-guided DNA binding agent comprises a sequence having at least 90% identity to SEQ ID NO: 57, optionally wherein the ORF of SEQ ID NO: 57 (i.e., SEQ ID NO: 4) is substituted with an alternative ORF of any one of SEQ ID NO: 7, 9, 10, 11, 12, 14, 15, 17, 18, 20, 21, 23, 24, 26, 27, 29, 30, 50, 52, 54, 65, 66, or 107-175.

In some embodiments, the mRNA comprising an ORF encoding an RNA-guided DNA binding agent comprises a sequence having at least 90% identity to SEQ ID NO: 58, optionally wherein the ORF of SEQ ID NO: 58 (i.e., SEQ ID NO: 4) is substituted with an alternative ORF of any one of SEQ ID NO: 7, 9, 10, 11, 12, 14, 15, 17, 18, 20, 21, 23, 24, 26, 27, 29, 30, 50, 52, 54, 65, 66, or 107-175.

In some embodiments, the mRNA comprising an ORF encoding an RNA-guided DNA binding agent comprises a sequence having at least 90% identity to SEQ ID NO: 59, optionally wherein the ORF of SEQ ID NO: 59 (i.e., SEQ ID NO: 4) is substituted with an alternative ORF of any one of SEQ ID NO: 7, 9, 10, 11, 12, 14, 15, 17, 18, 20, 21, 23, 24, 26, 27, 29, 30, 50, 52, 54, 65, 66, or 107-175.

In some embodiments, the mRNA comprising an ORF encoding an RNA-guided DNA binding agent comprises a sequence having at least 90% identity to SEQ ID NO: 60, optionally wherein the ORF of SEQ ID NO: 60 (i.e., SEQ ID NO: 4) is substituted with an alternative ORF of any one of SEQ ID NO: 7, 9, 10, 11, 12, 14, 15, 17, 18, 20, 21, 23, 24, 26, 27, 29, 30, 50, 52, 54, 65, 66, or 107-175.

In some embodiments, the mRNA comprising an ORF encoding an RNA-guided DNA binding agent comprises a sequence having at least 90% identity to SEQ ID NO: 61, optionally wherein the ORF of SEQ ID NO: 61 (i.e., SEQ ID NO: 4) is substituted with an alternative ORF of any one of SEQ ID NO: 7, 9, 10, 11, 12, 14, 15, 17, 18, 20, 21, 23, 24, 26, 27, 29, 30, 50, 52, 54, 65, 66, or 107-175.

In some embodiments, the mRNA comprising an ORF encoding an RNA-guided DNA binding agent comprises a sequence having at least 90% identity to SEQ ID NO: 176, optionally wherein the ORF of SEQ ID NO: 176 is substituted with an alternative ORF of any one of SEQ ID NO: 4, 7, 9, 10, 11, 12, 14, 15, 17, 18, 20, 21, 23, 24, 26, 27, 29, 30, 50, 52, 54, 65, 66, or 107-175.

In some embodiments, the mRNA comprising an ORF encoding an RNA-guided DNA binding agent comprises a sequence having at least 90% identity to SEQ ID NO: 177, optionally wherein the ORF of SEQ ID NO: 177 is substituted with an alternative ORF of any one of SEQ ID NO: 4, 7, 9, 10, 11, 12, 14, 15, 17, 18, 20, 21, 23, 24, 26, 27, 29, 30, 50, 52, 54, 65, 66, or 107-175.

In some embodiments, the mRNA comprising an ORF encoding an RNA-guided DNA binding agent comprises a sequence having at least 90% identity to SEQ ID NO: 178, optionally wherein the ORF of SEQ ID NO: 178 is substituted with an alternative ORF of any one of SEQ ID NO: 4, 7, 9, 10, 11, 12, 14, 15, 17, 18, 20, 21, 23, 24, 26, 27, 29, 30, 50, 52, 54, 65, 66, or 107-175.

In some embodiments, the mRNA comprising an ORF encoding an RNA-guided DNA binding agent comprises a sequence having at least 90% identity to SEQ ID NO: 179, optionally wherein the ORF of SEQ ID NO: 179 is substituted with an alternative ORF of any one of SEQ ID NO: 4, 7, 9, 10, 11, 12, 14, 15, 17, 18, 20, 21, 23, 24, 26, 27, 29, 30, 50, 52, 54, 65, 66, or 107-175.

In some embodiments, the mRNA comprising an ORF encoding an RNA-guided DNA binding agent comprises a sequence having at least 90% identity to SEQ ID NO: 180, optionally wherein the ORF of SEQ ID NO: 180 is substituted with an alternative ORF of any one of SEQ ID NO: 4, 7, 9, 10, 11, 12, 14, 15, 17, 18, 20, 21, 23, 24, 26, 27, 29, 30, 50, 52, 54, 65, 66, or 107-175.

In some embodiments, the mRNA comprising an ORF encoding an RNA-guided DNA binding agent comprises a sequence having at least 90% identity to SEQ ID NO: 181, optionally wherein the ORF of SEQ ID NO: 181 is substituted with an alternative ORF of any one of SEQ ID NO: 4, 7, 9, 10, 11, 12, 14, 15, 17, 18, 20, 21, 23, 24, 26, 27, 29, 30, 50, 52, 54, 65, 66, or 107-175.

In some embodiments, the mRNA comprising an ORF encoding an RNA-guided DNA binding agent comprises a sequence having at least 90% identity to SEQ ID NO: 182, optionally wherein the ORF of SEQ ID NO: 182 is substituted with an alternative ORF of any one of SEQ ID NO: 4, 7, 9, 10, 11, 12, 14, 15, 17, 18, 20, 21, 23, 24, 26, 27, 29, 30, 50, 52, 54, 65, 66, or 107-175.

In some embodiments, the mRNA comprising an ORF encoding an RNA-guided DNA binding agent comprises a sequence having at least 90% identity to SEQ ID NO: 183, optionally wherein the ORF of SEQ ID NO: 183 is substituted with an alternative ORF of any one of SEQ ID NO: 4, 7, 9, 10, 11, 12, 14, 15, 17, 18, 20, 21, 23, 24, 26, 27, 29, 30, 50, 52, 54, 65, 66, or 107-175.

In some embodiments, the mRNA comprising an ORF encoding an RNA-guided DNA binding agent comprises a sequence having at least 90% identity to SEQ ID NO: 184, optionally wherein the ORF of SEQ ID NO: 184 is substituted with an alternative ORF of any one of SEQ ID NO: 4, 7, 9, 10, 11, 12, 14, 15, 17, 18, 20, 21, 23, 24, 26, 27, 29, 30, 50, 52, 54, 65, 66, or 107-175.

In some embodiments, the mRNA comprising an ORF encoding an RNA-guided DNA binding agent comprises a sequence having at least 90% identity to SEQ ID NO: 185, optionally wherein the ORF of SEQ ID NO: 185 is substituted with an alternative ORF of any one of SEQ ID NO: 4, 7, 9, 10, 11, 12, 14, 15, 17, 18, 20, 21, 23, 24, 26, 27, 29, 30, 50, 52, 54, 65, 66, or 107-175.

In some embodiments, the degree of identity to the optionally substituted sequences of SEQ ID NOs 43, 44, 56-61, or 176-185 is at least 95%. In some embodiments, the degree of identity to the optionally substituted sequences of SEQ ID NOs 43, 44, 56-61, or 176-185 is at least 98%. In some embodiments, the degree of identity to the optionally substituted sequences of SEQ ID NOs 43, 44, 56-61, or 176-185 is at least 99%. In some embodiments, the degree of identity to the optionally substituted sequences of SEQ ID NOs 43, 44, 56-61, or 176-185 is 100%.

9. Poly-A Tail

In some embodiments, the mRNA further comprises a poly-adenylated (poly-A) tail. In some instances, the poly-A tail is "interrupted" with one or more non-adenine nucleotide "anchors" at one or more locations within the poly-A tail. The poly-A tails may comprise at least 8 consecutive adenine nucleotides, but also comprise one or more non-adenine nucleotide. As used herein, "non-adenine nucleotides" refer to any natural or non-natural nucleotides that do not comprise adenine. Guanine, thymine, and cytosine nucleotides are exemplary non-adenine nucleotides. Thus, the poly-A tails on the mRNA described herein may comprise consecutive adenine nucleotides located 3' to nucleotides encoding an RNA-guided DNA-binding agent or a sequence of interest. In some instances, the poly-A tails on mRNA comprise non-consecutive adenine nucleotides located 3' to nucleotides encoding an RNA-guided DNA-binding agent or a sequence of interest, wherein non-adenine nucleotides interrupt the adenine nucleotides at regular or irregularly spaced intervals.

In some embodiments, the poly-A tail is encoded in the plasmid used for in vitro transcription of mRNA and becomes part of the transcript. The poly-A sequence encoded in the plasmid, i.e., the number of consecutive adenine nucleotides in the poly-A sequence, may not be exact, e.g., a 100 poly-A sequence in the plasmid may not result in a precisely 100 poly-A sequence in the transcribed mRNA. In some embodiments, the poly-A tail is not encoded in the plasmid, and is added by PCR tailing or enzymatic tailing, e.g., using E. coli poly(A) polymerase.

In some embodiments, the one or more non-adenine nucleotides are positioned to interrupt the consecutive adenine nucleotides so that a poly(A) binding protein can bind to a stretch of consecutive adenine nucleotides. In some embodiments, one or more non-adenine nucleotide(s) is located after at least 8, 9, 10, 11, or 12 consecutive adenine nucleotides. In some embodiments, the one or more non-adenine nucleotide is located after at least 8-50 consecutive adenine nucleotides. In some embodiments, the one or more non-adenine nucleotide is located after at least 8-100 consecutive adenine nucleotides. In some embodiments, the non-adenine nucleotide is after one, two, three, four, five, six, or seven adenine nucleotides and is followed by at least 8 consecutive adenine nucleotides.

The poly-A tail of the present disclosure may comprise one sequence of consecutive adenine nucleotides followed by one or more non-adenine nucleotides, optionally followed by additional adenine nucleotides.

In some embodiments, the poly-A tail comprises or contains one non-adenine nucleotide or one consecutive stretch of 2-10 non-adenine nucleotides. In some embodiments, the non-adenine nucleotide(s) is located after at least 8, 9, 10, 11, or 12 consecutive adenine nucleotides. In some instances, the one or more non-adenine nucleotides are located after at least 8-50 consecutive adenine nucleotides. In some embodiments, the one or more non-adenine nucleotides are located after at least 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 consecutive adenine nucleotides.

In some embodiments, the non-adenine nucleotide is guanine, cytosine, or thymine. In some instances, the non-adenine nucleotide is a guanine nucleotide. In some embodiments, the non-adenine nucleotide is a cytosine nucleotide. In some embodiments, the non-adenine nucleotide is a thymine nucleotide. In some instances, where more than one non-adenine nucleotide is present, the non-adenine nucleotide may be selected from: a) guanine and thymine nucleotides; b) guanine and cytosine nucleotides; c) thymine and cytosine nucleotides; or d) guanine, thymine and cytosine nucleotides. An exemplary poly-A tail comprising non-adenine nucleotides is provided as SEQ ID NO: 62.

10. Modified Nucleotides

In some embodiments, an mRNA comprises a modified uridine at some or all uridine positions. In some embodiments, the modified uridine is a uridine modified at the 5 position, e.g., with a halogen or C1-C3 alkoxy. In some embodiments, the modified uridine is a pseudouridine modified at the 1 position, e.g., with a C1-C3 alkyl. The modified uridine can be, for example, pseudouridine, N1-methyl-pseudouridine, 5-methoxyuridine, 5-iodouridine, or a combination thereof. In some embodiments the modified uridine is 5-methoxyuridine. In some embodiments the modified uridine is 5-iodouridine. In some embodiments the modified uridine is pseudouridine. In some embodiments the modified uridine is N1-methyl-pseudouridine. In some embodiments, the modified uridine is a combination of pseudouridine and N1-methyl-pseudouridine. In some embodiments, the modified uridine is a combination of pseudouridine and 5-methoxyuridine. In some embodiments, the modified uridine is a combination of N1-methyl pseudouridine and 5-methoxyuridine. In some embodiments, the modified uridine is a combination of 5-iodouridine and N1-methyl-pseudouridine. In some embodiments, the modified uridine is a combination of pseudouridine and 5-iodouridine. In some embodiments, the modified uridine is a combination of 5-iodouridine and 5-methoxyuridine.

In some embodiments, at least 10%, 15%, 20%, 25%, 30%, 35%, 40%, 45%, 50%, 55%, 60%, 65%, 70%, 75%, 80%, 85%, 90%, 95%, 98%, 99%, or 100% of the uridine positions in an mRNA according to the disclosure are modified uridines. In some embodiments, 10%-25%, 15-25%. 25-35%, 35-45%, 45-55%, 55-65%, 65-75%, 75-85%, 85-95%, or 90-100% of the uridine positions in an mRNA according to the disclosure are modified uridines, e.g., 5-methoxyuridine, 5-iodouridine, N1-methyl pseudouridine, pseudouridine, or a combination thereof. In some embodiments, 10%-25%, 15-25%, 25-35%, 35-45%, 45-55%, 55-65%, 65-75%, 75-85%, 85-95%, or 90-100% of the uridine positions in an mRNA according to the disclosure are 5-methoxyuridine. In some embodiments, 10%-25%, 15-25%, 25-35%, 35-45%, 45-55%, 55-65%, 65-75%, 75-85%, 85-95%, or 90-100% of the uridine positions in an mRNA according to the disclosure are pseudouridine. In some embodiments, 10%-25%, 15-25%, 25-35%, 35-45%, 45-55%, 55-65%, 65-75%, 75-85%, 85-95%, or 90-100% of the uridine positions in an mRNA according to the disclosure are N1-methyl pseudouridine. In some embodiments, 10%-25%, 15-25%, 25-35%, 35-45%, 45-55%, 55-65%, 65-75%, 75-85%, 85-95%, or 90-100% of the uridine positions in an mRNA according to the disclosure are 5-iodouridine. In some embodiments, 10%-25%, 15-25%, 25-35%, 35-45%, 45-55%, 55-65%, (65-75%, 75-85%, 85-95%, or 90-100% of the uridine positions in an mRNA according to the disclosure are 5-methoxyuridine, and the remainder are N1-methyl pseudouridine. In some embodiments, 10%-25%, 15-25%, 25-35%, 35-45%, 45-55%, 55-65%, 65-75%, 75-85%, 85-95%, or 90-100% of the uridine positions in an mRNA according to the disclosure are 5-iodouridine, and the remainder are N1-methyl pseudouridine.

11. 5' Cap

In some embodiments, an mRNA disclosed herein comprises a 5' cap, such as a Cap0, Cap1, or Cap2. A 5' cap is generally a 7-methylguanine ribonucleotide (which may be further modified, as discussed below e.g. with respect to ARCA) linked through a 5'-triphosphate to the 5' position of the first nucleotide of the 5'-to-3' chain of the mRNA, i.e., the first cap-proximal nucleotide. In Cap0, the riboses of the first and second cap-proximal nucleotides of the mRNA both comprise a 2'-hydroxyl. In Cap1, the riboses of the first and second transcribed nucleotides of the mRNA comprise a 2'-methoxy and a 2'-hydroxyl, respectively. In Cap2, the riboses of the first and second cap-proximal nucleotides of the mRNA both comprise a 2'-methoxy. See, e.g., Katibah et al. (2014) Proc Natl Acad Sci USA 111(33):12025-30; Abbas et al. (2017) Proc Natl Acad Sci USA 114(11):E2106-E2115. Most endogenous higher eukaryotic mRNAs, including mammalian mRNAs such as human mRNAs, comprise Cap1 or Cap2. Cap0 and other cap structures differing from Cap1 and Cap2 may be immunogenic in mammals, such as humans, due to recognition as "non-self" by components of the innate immune system such as IFIT-1 and IFIT-5, which can result in elevated cytokine levels including type I interferon. Components of the innate immune system such as IFIT-1 and IFIT-5 may also compete with eIF4E for binding of an mRNA with a cap other than Cap1 or Cap2, potentially inhibiting translation of the mRNA.

A cap can be included co-transcriptionally. For example, ARCA (anti-reverse cap analog; Thermo Fisher Scientific Cat. No. AM8045) is a cap analog comprising a 7-methyl-guanine 3'-methoxy-5'-triphosphate linked to the 5' position of a guanine ribonucleotide which can be incorporated in vitro into a transcript at initiation. ARCA results in a Cap0 cap in which the 2' position of the first cap-proximal nucleotide is hydroxyl. See, e.g., Stepinski et al., (2001) "Synthesis and properties of mRNAs containing the novel 'anti-reverse' cap analogs 7-methyl(3'-O-methyl)GpppG and 7-methyl(3'deoxy)GpppG," RNA 7: 1486-1495. The ARCA structure is shown below.

commercially available (New England Biolabs Cat. No. M2080S) and has RNA triphosphatase and guanylyltransferase activities, provided by its D1 subunit, and guanine methyltrnsferase, provided by its D12 subunit. As such, it can add a 7-methylguanine to an RNA, so as to give Cap0, in the presence of S-adenosyl methionine and GTP. See, e.g., Guo, P. and Moss, B. (1990) *Proc. Natl. Acad. Sci. USA* 87, 4023-4027; Mao, X. and Shuman, S. (1994) *J. Biol. Chem.* 269, 24472-24479. For additional discussion of caps and capping approaches, see, e.g., WO2017/053297 and Ishikawa et al., Nucl. Acids. Symp. Ser. (2009) No. 53, 129-130.

12. Guide RNA

In some embodiments, at least one guide RNA is provided in combination with an mRNA disclosed herein. In some embodiments, a guide RNA is provided as a separate molecule from the mRNA. In some embodiments, a guide RNA

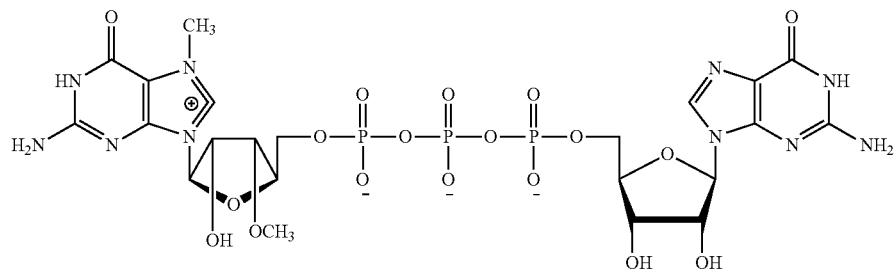

CleanCap™ AG (m7G(5')ppp(5')(2'OMeA)pG; TriLink Biotechnologies Cat. No. N-7113) or CleanCap™ GG (m7G (5')ppp(5')(2'OMeG)pG; TriLink Biotechnologies Cat. No. N-7133) can be used to provide a Cap1 structure co-transcriptionally. 3'-O-methylated versions of CleanCap™ AG and CleanCap™ GG are also available from TriLink Biotechnologies as Cat. Nos. N-7413 and N-7433, respectively. The CleanCap™ AG structure is shown below. Clean-Cap™ structures are sometimes referred to herein using the last three digits of the catalog numbers listed above (e.g., "CleanCap™ 113" for TriLink Biotechnologies Cat. No. N-7113).

is provided as a part, such as a part of a UTR, of an mRNA disclosed herein. In some embodiments, at least one guide RNA targets TTR.

In some embodiments, a guide RNA comprises a modified sgRNA. In some embodiments, the sgRNA comprises the modification pattemn shown in SEQ ID NO: 74, where N is any natural or non-natural nucleotide, and where the totality of the N's comprise a guide sequence. For example, encompassed herein is SEQ ID NO: 74, where the N's are replaced with any of the guide sequences disclosed herein. The modifications are as shown in SEQ ID NO: 74 despite the substitution of N's for the nucleotides of a guide. That is,

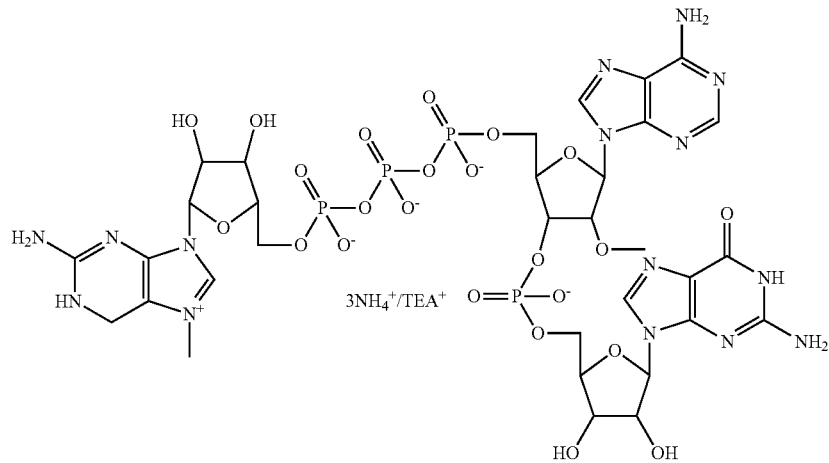 [SMILES: COC1C(OP(=O)([O-])OCC2OC(n3cnc4c(=O)[nH]c(N)nc43)C(O)C2O)C(COP(=O)([O-])OP(=O)([O-])OP(=O)([O-])OCC2OC(n3c[n+](C)c4c3N=C(N)NC4)C(O)C2O)OC1n1cnc2c(N)ncnc21]

Alternatively, a cap can be added to an RNA post-transcriptionally. For example, Vaccinia capping enzyme is although the nucleotides of the guide replace the "N's", the first three nucleotides are 2'OMe modified and there are phosphorothioate linkages between the first and second nucleotides, the second and third nucleotides and the third and fourth nucleotides.

13. Lipids; Formulation; Delivery

In some embodiments, an mRNA described herein, alone or accompanied by one or more guide RNAs, is formulated in or administered via a lipid nanoparticle; see, e.g., PCT/US2017/024973, filed Mar. 30, 2017, claiming priority to U.S. Ser. No. 62/315,602, filed Mar. 30, 2016 and entitled "LIPID NANOPARTICLE FORMULATIONS FOR CRISPR/CAS COMPONENTS," the contents of which are hereby incorporated by reference in their entirety. Any lipid nanoparticle (LNP) known to those of skill in the art to be capable of delivering nucleotides to subjects may be utilized to administer the RNAs described herein, which in some embodiments are accompanied by one or more guide RNAs. In some embodiments, an mRNA described herein, alone or accompanied by one or more guide RNAs, is formulated in or administered via liposome, a nanoparticle, an exosome, or a microvesicle. Emulsions, micelles, and suspensions may be suitable compositions for local and/or topical delivery.

Disclosed herein are various embodiments of LNP formulations for RNAs, including CRISPR/Cas cargoes. Such LNP formulations may include (i) a CCD lipid, such as an amine lipid, (ii) a neutral lipid, (iii) a helper lipid, and (iv) a stealth lipid, such as a PEG lipid. Some embodiments of the LNP formulations include an "amine lipid", along with a helper lipid, a neutral lipid, and a stealth lipid such as a PEG lipid. By "lipid nanoparticle" is meant a particle that comprises a plurality of (i.e. more than one) lipid molecules physically associated with each other by intermolecular forces.

CCD Lipids

Lipid compositions for delivery of CRISPR/Cas mRNA and guide RNA components to a liver cell comprise a CCD Lipid.

In some embodiments, the CCD lipid is Lipid A, which is (9Z,12Z)-3-((4,4-bis(octyloxy)butanoyl)oxy)-2-((((3-(diethylamino)propoxy)carbonyl)oxy)methyl)propyl octadeca-9,12-dienoate, also called 3-((4,4-bis(octyloxy)butanoyl)oxy)-2-((((3-(diethylamino)propoxy)carbonyl)oxy)methyl) propyl (9Z,12Z)-octadeca-9,12-dienoate. Lipid A can be depicted as:

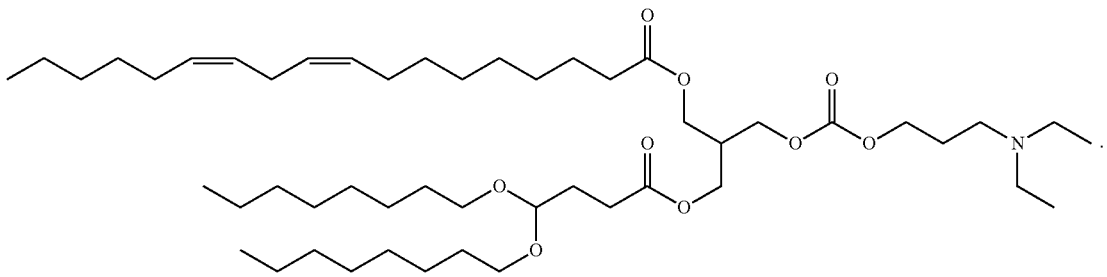 [SMILES: CCCCC/C=C\C/C=C\CCCCCCCC(=O)OCC(COC(=O)CCC(OCCCCCCCC)OCCCCCCCC)COC(=O)OCCCN(CC)CC]

Lipid A may be synthesized according to WO2015/095340 (e.g., pp. 84-86).

In some embodiments, the CCD lipid is Lipid B, which is ((5-((dimethylamino)methyl)-1,3-phenylene)bis(oxy))bis(octane-8,1-divl)bis(decanoate), also called ((5-((dimethylamino)methyL)-1,3-phenylene)bis(oxy))bis(octane-8,1-diyl) bis(decanoate). Lipid B can be depicted as:

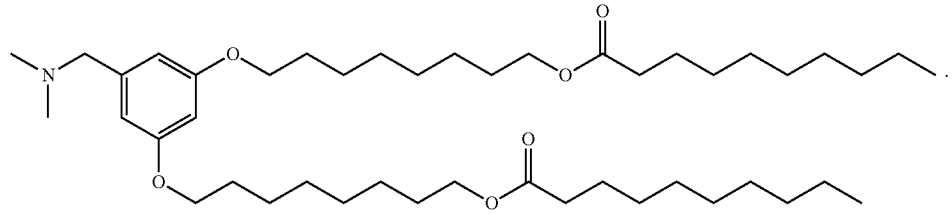 [SMILES: CCCCCCCCCC(=O)OCCCCCCCCOc1cc(CN(C)C)cc(OCCCCCCCCOC(=O)CCCCCCCCC)c1]

Lipid B may be synthesized according to WO2014/136086 (e.g., pp. 107-09).

In some embodiments, the CCD lipid is Lipid C, which is 2-((4-(((3-(dimethylamino)propoxy)carbonyl)oxy)hexadecanoyl)oxy)propane-1,3-diyl (9Z,9'Z,12Z,12'Z)-bis(octadeca-9,12-dienoate).

Lipid C can be depicted as:

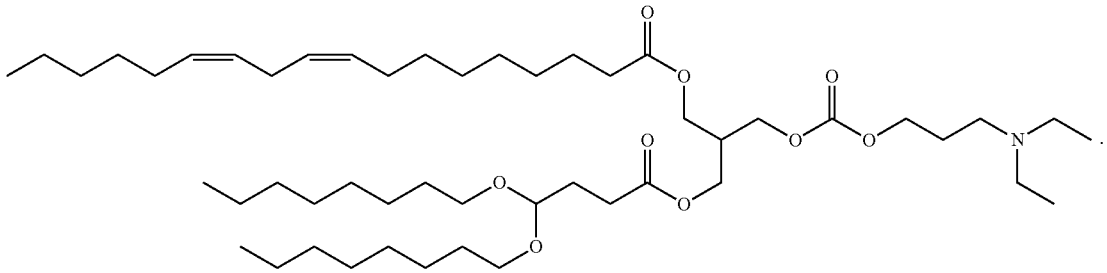

In some embodiments, the CCD lipid is Lipid D, which is 3-(((3-(dimethylamino)propoxy)carbonyl)oxy)-13-(octanoyloxy)tridecyl 3-octylundecanoate.

Lipid D can be depicted as:

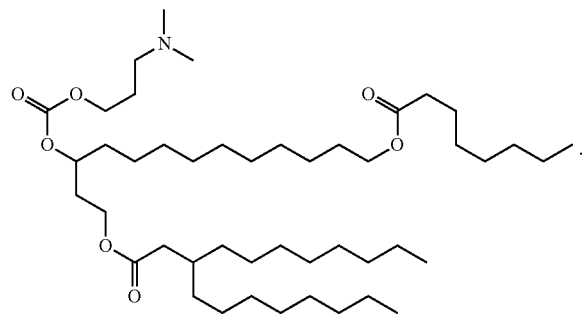

Lipid C and Lipid D may be synthesized according to WO2015/095340.

The CCD lipid can also be an equivalent to Lipid A, Lipid B, Lipid C, or Lipid D. In certain embodiments, the CCD lipid is an equivalent to Lipid A, an equivalent to Lipid B, an equivalent to Lipid C, or an equivalent to Lipid D.

Amine Lipids

In some embodiments, the LNP compositions for the delivery of biologically active agents comprise an "amine lipid", which is defined as Lipid A or its equivalents, including acetal analogs of Lipid A.

In some embodiments, the amine lipid is Lipid A, which is (9Z,12Z)-3-((4,4-bis(octyloxy)butanoyl)oxy)-2-((((3-(diethylamino)propoxy)carbonyl)oxy)methyl)propyl octadeca-9,12-dienoate, also called 3-((4,4-bis(octyloxy)butanoyl)oxy)-2-((((3-(diethylamino)propoxy)carbonyl)oxy)methyl)propyl (9Z,12Z)-octadeca-9,12-dienoate. Lipid A can be depicted as:

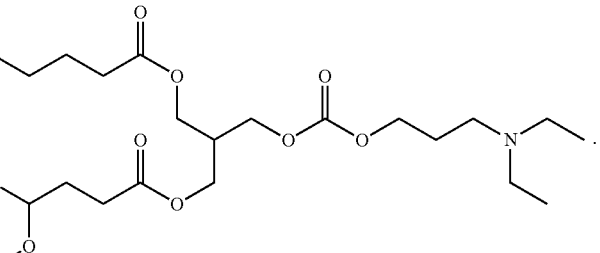

Lipid A may be synthesized according to WO2015/095340 (e.g., pp. 84-86). In certain embodiments, the amine lipid is an equivalent to Lipid A.

In certain embodiments, an amine lipid is an analog of Lipid A. In certain embodiments, a Lipid A analog is an acetal analog of Lipid A. In particular LNP compositions, the acetal analog is a C4-C12 acetal analog. In some embodiments, the acetal analog is a C5-C12 acetal analog. In additional embodiments, the acetal analog is a C5-C10 acetal analog. In further embodiments, the acetal analog is chosen from a C4, C5, C6, C7, C9, C10, C11, and C12 acetal analog.

Amine lipids suitable for use in the LNPs described herein are biodegradable in vivo. The amine lipids have low toxicity (e.g., are tolerated in animal models without adverse effect in amounts of greater than or equal to 10 mg/kg). In certain embodiments, LNPs comprising an amine lipid include those where at least 75% of the amine lipid is cleared from the plasma within 8, 10, 12, 24, or 48 hours, or 3, 4, 5, 6, 7, or 10 days. In certain embodiments, LNPs comprising an amine lipid include those where at least 50% of the mRNA or gRNA is cleared from the plasma within 8, 10, 12, 24, or 48 hours, or 3, 4, 5, 6, 7, or 10 days. In certain embodiments, LNPs comprising an amine lipid include those where at least 50% of the LNP is cleared from the plasma within 8, 10, 12, 24, or 48 hours, or 3, 4, 5, 6, 7, or 10 days, for example by measuring a lipid (e.g. an amine lipid), RNA (e.g. mRNA), or other component. In certain embodiments, lipid-encapsulated versus free lipid, RNA, or nucleic acid component of the LNP is measured.

Lipid clearance may be measured as described in literature. See Maier, M. A., et al. Biodegradable Lipids Enabling Rapidly Eliminated Lipid Nanoparticles for Systemic Delivery of RNAi Therapeutics. Mol. Ther. 2013, 21(8), 1570-78 ("Maier"). For example, in Maier, LNP-siRNA systems containing luciferases-targeting siRNA were administered to six- to eight-week old male C57Bl/6 mice at 0.3 mg/kg by intravenous bolus injection via the lateral tail vein. Blood, liver, and spleen samples were collected at 0.083, 0.25, 0.5, 1, 2, 4, 8, 24, 48, 96, and 168 hours post-dose. Mice were perfused with saline before tissue collection and blood samples were processed to obtain plasma. All samples were processed and analyzed by LC-MS. Further, Maier describes a procedure for assessing toxicity after administration of

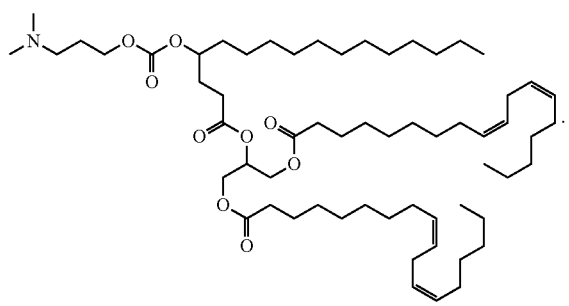 [SMILES: CCCCC/C=C\C/C=C\CCCCCCCC(=O)OCC(COC(=O)CCCCCCC/C=C\C/C=C\CCCCC)OC(=O)CCC(CCCCCCCCCCCC)OC(=O)OCCCN(C)C]

LNP-siRNA formulations. For example, a luciferase-targeting siRNA was administered at 0, 1, 3, 5, and 10 mg/kg (5 animals/group) via single intravenous bolus injection at a dose volume of 5 mL/kg to male Sprague-Dawley rats. After 24 hours, about 1 mL of blood was obtained from the jugular vein of conscious animals and the serum was isolated. At 72 hours post-dose, all animals were euthanized for necropsy. Assessment of clinical signs, body weight, serum chemistry, organ weights and histopathology was performed. Although Maier describes methods for assessing siRNA-LNP formulations, these methods may be applied to assess clearance, pharmacokinetics, and toxicity of administration of LNP compositions of the present disclosure.

The amine lipids lead to an increased clearance rate. In some embodiments, the clearance rate is a lipid clearance rate, for example the rate at which an amine lipid is cleared from the blood, serum, or plasma. In some embodiments, the clearance rate is an RNA clearance rate, for example the rate at which an mRNA or a gRNA is cleared from the blood, serum, or plasma. In some embodiments, the clearance rate is the rate at which LNP is cleared from the blood, serum, or plasma. In some embodiments, the clearance rate is the rate at which LNP is cleared from a tissue, such as liver tissue or spleen tissue. In certain embodiments, a high rate of clearance rate leads to a safety profile with no substantial adverse effects. The amine lipids reduce LNP accumulation in circulation and in tissues. In some embodiments, a reduction in LNP accumulation in circulation and in tissues leads to a safety profile with no substantial adverse effects.

The amine lipids of the present disclosure may be ionizable depending upon the pH of the medium they are in. For example, in a slightly acidic medium, the amine lipids may be protonated and thus bear a positive charge. Conversely, in a slightly basic medium, such as, for example, blood where pH is approximately 7.35, the amine lipids may not be protonated and thus bear no charge. In some embodiments, the amine lipids of the present disclosure may be protonated at a pH of at least about 9. In some embodiments, the amine lipids of the present disclosure may be protonated at a pH of at least about 9. In some embodiments, the amine lipids of the present disclosure may be protonated at a pH of at least about 10.

The ability of an amine lipid to bear a charge is related to its intrinsic pKa. For example, the amine lipids of the present disclosure may each, independently, have a pKa in the range of from about 5.8 to about 6.2. For example, the amine lipids of the present disclosure may each, independently, have a pKa in the range of from about 5.8 to about 6.5. This may be advantageous as it has been found that cationic lipids with a pKa ranging from about 5.1 to about 7.4 are effective for delivery of cargo in vivo, e.g. to the liver. Further, it has been found that cationic lipids with a pKa ranging from about 5.3 to about 6.4 are effective for delivery in vivo, e.g. to tumors. See, e.g., WO2014/136086.

Additional Lipids

"Neutral lipids" suitable for use in a lipid composition of the disclosure include, for example, a variety of neutral, uncharged or zwitterionic lipids. Examples of neutral phospholipids suitable for use in the present disclosure include, but are not limited to, 5-heptadecylbenzene-1,3-diol (resorcinol), dipalmitoylphosphatidylcholine (DPPC), distearoylphosphatidylcholine (DSPC), pohsphocholine (DOPC), dimyristoylphosphatidylcholine (DMPC), phosphatidylcholine (PLPC), 1,2-distearoyl-sn-glycero-3-phosphocholine (DAPC), phosphatidylethanolamine (PE), egg phosphatidylcholine (EPC), dilauryloylphosphatidylcholine (DLPC), dimyristoylphosphatidylcholine (DMPC), 1-myristoyl-2-palmitoyl phosphatidylcholine (MPPC), 1-palmitoyl-2-myristoyl phosphatidylcholine (PMPC), 1-palmitoyl-2-stearoyl phosphatidylcholine (PSPC), 1,2-diarachidoyl-sn-glycero-3-phosphocholine (DBPC), 1-stearoyl-2-palmitoyl phosphatidylcholine (SPPC), 1,2-dieicosenoyl-sn-glycero-3-phosphocholine (DEPC), palmitoyloleoyl phosphatidylcholine (POPC), lysophosphatidyl choline, dioleoyl phosphatidylethanolamine (DOPE), dilinoleoylphosphatidylcholine distearoylphosphatidylethanolarnine (DSPE), dimyristoyl phosphatidylethanolamine (DMPE), dipalmitoyl phosphatidylethanolamine (DPPE), palmitoyloleoyl phosphatidylethanolamine (POPE), lyso-phosphatidylethanolamine and combinations thereof. In one embodiment, the neutral phospholipid may be selected from the group consisting of distearoylphosphatidylcholine (DSPC) and dimyristoyl phosphatidyl ethanolamine (DMPE). In another embodiment, the neutral phospholipid may be distearoylphosphatidylcholine (DSPC).

"Helper lipids" include steroids, sterols, and alkyl resorcinols. Helper lipids suitable for use in the present disclosure include, but are not limited to, cholesterol, 5-heptadecylresorcinol, and cholesterol hemisuccinate. In one embodiment, the helper lipid may be cholesterol. In one embodiment, the helper lipid may be cholesterol hemisuccinate.

"Stealth lipids" are lipids that alter the length of time the nanoparticles can exist in vivo (e.g., in the blood). Stealth lipids may assist in the formulation process by, for example, reducing particle aggregation and controlling particle size. Stealth lipids used herein may modulate pharmacokinetic properties of the LNP. Stealth lipids suitable for use in a lipid composition of the disclosure include, but are not limited to, stealth lipids having a hydrophilic head group linked to a lipid moiety. Stealth lipids suitable for use in a lipid composition of the present disclosure and information about the biochemistry of such lipids can be found in Romberg et al., Pharmaceutical Research, Vol. 25, No. 1, 2008, pg. 55-71 and Hoekstra et al., Biochimica et Biophysica Acta 1660 (2004) 41-52. Additional suitable PEG lipids are disclosed, e.g., in WO 2006/007712.

In one embodiment, the hydrophilic head group of stealth lipid comprises a polymer moiety selected from polymers based on PEG. Stealth lipids may comprise a lipid moiety. In some embodiments, the stealth lipid is a PEG lipid.

In one embodiment, a stealth lipid comprises a polymer moiety selected from polymers based on PEG (sometimes referred to as poly(ethylene oxide)), poly(oxazoline), poly(vinyl alcohol), poly(glycerol), poly(N-vinylpyrrolidone), polyaminoacids and poly[N-(2-hydroxypropyl)methacrylamide].

In one embodiment, the PEG lipid comprises a polymer moiety based on PEG (sometimes referred to as poly(ethylene oxide)).

The PEG lipid further comprises a lipid moiety. In some embodiments, the lipid moiety may be derived from diacylglycerol or diacylglycamide, including those comprising a dialkylglycerol or dialkylglycamide group having alkyl chain length independently comprising from about C4 to about C40 saturated or unsaturated carbon atoms, wherein the chain may comprise one or more functional groups such as, for example, an amide or ester. In some embodiments, the alkyl chail length comprises about C10 to C20. The dialkylglycerol or dialkylglycamide group can further comprise one or more substituted alkyl groups. The chain lengths may be symmetrical or assymetric.

Unless otherwise indicated, the term "PEG" as used herein means any polyethylene glycol or other polyalkylene ether polymer. In one embodiment, PEG is an optionally substituted linear or branched polymer of ethylene glycol or ethylene oxide. In one embodiment, PEG is unsubstituted. In one embodiment, the PEG is substituted, e.g., by one or more alkyl, alkoxy, acyl, hydroxy, or aryl groups. In one embodiment, the term includes PEG copolymers such as PEG-polyurethane or PEG-polypropylene (see, e.g., J. Milton Harris, Poly(ethylene glycol) chemistry: biotechnical and biomedical applications (1992)); in another embodiment, the term does not include PEG copolymers. In one embodiment, the PEG has a molecular weight of from about 130 to about 50,000, in a sub-embodiment, about 150 to about 30,000, in a sub-embodiment, about 150 to about 20,000, in a sub-embodiment about 150 to about 15,000, in a sub-embodiment, about 150 to about 10,000, in a sub-embodiment, about 150 to about 6,000, in a sub-embodiment, about 150 to about 5,000, in a sub-embodiment, about 150 to about 4,000, in a sub-embodiment, about 150 to about 3,000, in a sub-embodiment, about 300 to about 3,000, in a sub-embodiment, about 1,000 to about 3,000, and in a sub-embodiment, about 1,500 to about 2,500.

In certain embodiments, the PEG (e.g., conjugated to a lipid moiety or lipid, such as a stealth lipid), is a "PEG-2K," also termed "PEG 2000," which has an average molecular weight of about 2,000 daltons. PEG-2K is represented herein by the following formula (I), wherein n is 45, meaning that the number averaged degree of polymerization comprises about 45 subunits. However, other PEG embodiments known in the art may be used, including, e.g., those where the number-averaged degree of polymerization comprises about 23 subunits (n=23), and/or 68 subunits (n=68). In some embodiments, n may range from about 30 to about 60. In some embodiments, n may range from about 35 to about 55. In some embodiments, n may range from about 40 to about 50. In some embodiments, n may range from about 42 to about 48. In some embodiments, n may be 45. In some embodiments, R may be selected from H, substituted alkyl, and unsubstituted alkyl. In some embodiments, R may be unsubstituted alkyl. In some embodiments, R may be methyl.

In any of the embodiments described herein, the PEG lipid may be selected from PEG-dilauroylglycerol, PEG-dimyristoylglycerol (PEG-DMG) (catalog #GM-020 from NOF, Tokyo, Japan), PEG-dipalmitoylglycerol, PEG-distearoylglycerol (PEG-DSPE) (catalog #DSPE-020CN, NOF, Tokyo, Japan), PEG-dilaurylglycamide, PEG-dimyristylglycamide, PEG-dipalmitoylglycamide, and PEG-distearoylglycamide, PEG-cholesterol (1-[8'-(Cholest-5-en-3(beta]-oxy)carboxamido-3',6'-dioxaoctanyl]carbamoyl-[omega]-methyl-poly(ethylene glycol), PEG-DMB (3,4-ditetradecoxylbenzyl-[omega]-methyl-poly(ethylene glycol)ether), 1,2-dimyristoyl-sn-glycero-3-phosphoethanolamine-N-[methoxy(polyethylene glycol)-2000] (PEG2k-DMG) (cat. #880150P from Avanti Polar Lipids, Alabaster, Ala., USA), 1,2-distearoyl-sn-glycero-3-phosphoethanolamine-N-[methoxy(polyethylene glycol)-2000] (PEG2k-DSPE) (cat. #880120C from Avanti Polar Lipids, Alabaster, Ala., USA), 1,2-distearoyl-sn-glycerol, methoxypolyethylene glycol (PEG2k-DSG; GS-020, NOF Tokyo, Japan), poly(ethylene glycol)-2000-dimethacrylate (PEG2k-DMA), and 1,2-distearyloxypropyl-3-amine-N-[methoxy(polyethylene glycol)-2000] (PEG2k-DSA). In one embodiment, the PEG lipid may be PEG2k-DMG. In some embodiments, the PEG lipid may be PEG2k-DSG. In one embodiment, the PEG lipid may be PEG2k-DSPE. In one embodiment, the PEG lipid may be PEG2k-DMA. In one embodiment, the PEG lipid may be PEG2k-C-DMA. In one embodiment, the PEG lipid may be compound S027, disclosed in WO2016/010840 (paragraphs [00240] to [00244]). In one embodiment, the PEG lipid may be PEG2k-DSA. In one embodiment, the PEG lipid may be PEG2k-C11. In some embodiments, the PEG lipid may be PEG2k-C14. In some embodiments, the PEG lipid may be PEG2k-C16. In some embodiments, the PEG lipid may be PEG2k-C18.

The LNP may contain (i) an amine lipid for encapsulation and for endosomal escape, (ii) a neutral lipid for stabilization, (iii) a helper lipid, also for stabilization, and (iv) a stealth lipid, such as a PEG lipid.

In some embodiments, an LNP composition may comprise an RNA component that includes one or more of an RNA-guided DNA-binding agent, a Cas nuclease mRNA, a Class 2 Cas nuclease mRNA, a Cas9 mRNA, and a gRNA. In some embodiments, an LNP composition may include a Class 2 Cas nuclease and a gRNA as the RNA component. In certain embodiments, an LNP composition may comprise the RNA component, an amine lipid, a helper lipid, a neutral lipid, and a stealth lipid. In certain LNP compositions, the helper lipid is cholesterol. In other compositions, the neutral lipid is DSPC. In additional embodiments, the stealth lipid is PEG2k-DMG or PEG2k-C11. In certain embodiments, the LNP composition comprises Lipid A or an equivalent of Lipid A; a helper lipid; a neutral lipid; a stealth lipid; and a guide RNA. In certain compositions, the amine lipid is Lipid A. In certain compositions, the amine lipid is Lipid A or an acetal analog thereof; the helper lipid is cholesterol; the neutral lipid is DSPC; and the stealth lipid is PEG2k-DMG.

In certain embodiments, lipid compositions are described according to the respective molar ratios of the component lipids in the formulation. Embodiments of the present disclosure provide lipid compositions described according to the respective molar ratios of the component lipids in the formulation. In one embodiment, the mol-% of the amine lipid may be from about 30 mol-% to about 60 mol-%. In one embodiment, the mol-% of the amine lipid may be from about 40 mol-% to about 60 mol-%. In one embodiment, the mol-% of the amine lipid may be from about 45 mol-% to about 60 mol-%. In one embodiment, the mol-% of the amine lipid may be from about 50 mol-% to about 60 mol-%. In one embodiment, the mol-% of the amine lipid may be from about 55 mol-% to about 60 mol-%. In one embodiment, the mol-% of the amine lipid may be from about 50 mol-% to about 55 mol-%. In one embodiment, the mol-% of the amine lipid may be about 50 mol-%. In one embodiment, the mol-% of the amine lipid may be about 55 mol-%. In some embodiments, the amine lipid mol-% of the LNP batch will be ±30%, ±25%, ±20%, ±15%, ±10%, ±5%, or ±2.5% of the target mol-%. In some embodiments, the amine lipid mol-% of the LNP batch will be ±4 mol-%, ±3 mol-%, ±2 mol-%, ±1.5 mol-%, +1 mol-%, ±0.5 mol-%, or ±0.25 mol-% of the target mol-%. All mol-% numbers are given as a fraction of the lipid component of the LNP compositions. In certain embodiments, LNP inter-lot variability of the amine lipid mol-% will be less than 15%, less than 10% or less than 5%.

In one embodiment, the mol-% of the neutral lipid may be from about 5 mol-% to about 15 mol-%. In one embodiment, the mol-% of the neutral lipid may be from about 7 mol-% to about 12 mol-%. In one embodiment, the mol-% of the neutral lipid may be about 9 mol-%. In some embodiments, the neutral lipid mol-% of the LNP batch will be ±30%, ±25%, ±20%, ±15%, ±10%, ±5%, or ±2.5% of the target neutral lipid mol-%. In certain embodiments, LNP inter-lot variability will be less than 15%, less than 10% or less than 5%.

In one embodiment, the mol-% of the helper lipid may be from about 20 mol-% to about 60 mol-%. In one embodiment, the mol-% of the helper lipid may be from about 25 mol-% to about 55 mol-%. In one embodiment, the mol-% of the helper lipid may be from about 25 mol-% to about 50 mol-%. In one embodiment, the mol-% of the helper lipid may be from about 25 mol-% to about 40 mol-%. In one embodiment, the mol-% of the helper lipid may be from about 30 mol-% to about 50 mol-%. In one embodiment, the mol-% of the helper lipid may be from about 30 mol-% to about 40 mol-%. In one embodiment, the mol-% of the helper lipid is adjusted based on amine lipid, neutral lipid, and PEG lipid concentrations to bring the lipid component to 100 mol-%. In some embodiments, the helper mol-% of the LNP batch will be ±30%, ±25%, ±20%, ±15%, ±10%, ±5%, or ±2.5% of the target mol-%. In certain embodiments, LNP inter-lot variability will be less than 15%, less than 10% or less than 5%.

In one embodiment, the mol-% of the PEG lipid may be from about 1 mol-% to about 10 mol-%. In one embodiment, the mol-% of the PEG lipid may be from about 2 mol-% to about 10 mol-%. In one embodiment, the mol-% of the PEG lipid may be from about 2 mol-% to about 8 mol-%. In one embodiment, the mol-% of the PEG lipid may be from about 2 mol-% to about 4 mol-%. In one embodiment, the mol-% of the PEG lipid may be from about 2.5 mol-% to about 4 mol-%. In one embodiment, the mol-% of the PEG lipid may be about 3 mol-%. In one embodiment, the mol-% of the PEG lipid may be about 2.5 mol-%. In some embodiments, the PEG lipid mol-% of the LNP batch will be ±30%, ±25%, ±20%, ±15%, ±10%, ±5%, or 2.5% of the target PEG lipid mol-%. In certain embodiments, LNP inter-lot variability will be less than 15%, less than 10% or less than 5%.

In certain embodiments, the cargo includes an mRNA encoding an RNA-guided DNA-binding agent (e.g. a Cas nuclease, a Class 2 Cas nuclease, or Cas9), and a gRNA or a nucleic acid encoding a gRNA, or a combination of mRNA and gRNA. In one embodiment, an LNP composition may comprise a Lipid A or its equivalents. In some aspects, the amine lipid is Lipid A In some aspects, the amine lipid is a Lipid A equivalent, e.g. an analog of Lipid A. In certain aspects, the amine lipid is an acetal analog of Lipid A. In various embodiments, an LNP composition comprises an amine lipid, a neutral lipid, a helper lipid, and a PEG lipid. In certain embodiments, the helper lipid is cholesterol. In certain embodiments, the neutral lipid is DSPC. In specific embodiments, PEG lipid is PEG2k-DMG. In some embodiments, an LNP composition may comprise a Lipid A, a helper lipid, a neutral lipid, and a PEG lipid. In some embodiments, an LNP composition comprises an amine lipid, DSPC, cholesterol, and a PEG lipid. In some embodiments, the LNP composition comprises a PEG lipid comprising DMG. In certain embodiments, the amine lipid is selected from Lipid A, and an equivalent of Lipid A, including an acetal analog of Lipid A. In additional embodiments, an LNP composition comprises Lipid A, cholesterol, DSPC, and PEG2k-DMG.

Embodiments of the present disclosure also provide lipid compositions described according to the molar ratio between the positively charged amine groups of the amine lipid (N) and the negatively charged phosphate groups (P) of the nucleic acid to be encapsulated. This may be mathematically represented by the equation N/P. In some embodiments, an LNP composition may comprise a lipid component that comprises an amine lipid, a helper lipid, a neutral lipid, and a helper lipid; and a nucleic acid component, wherein the N/P ratio is about 3 to 10. In some embodiments, an LNP composition may comprise a lipid component that comprises an amine lipid, a helper lipid, a neutral lipid, and a helper lipid; and an RNA component, wherein the N/P ratio is about 3 to 10. In one embodiment, the N/P ratio may about 5-7. In one embodiment, the N/P ratio may about 4.5-8. In one embodiment, the N/P ratio may about 6. In one embodiment, the N/P ratio may be 6±1. In one embodiment, the N/P ratio may about 6±0.5. In some embodiments, the N/P ratio will be ±30%, ±25%, ±20%, ±15%, ±10%, ±5%, or ±2.5% of the target N/P ratio. In certain embodiments, LNP inter-lot variability will be less than 15%, less than 10% or less than 5%.

In some embodiments, the RNA component may comprise an mRNA, such as an mRNA disclosed herein, e.g., encoding a Cas nuclease. In one embodiment, RNA component may comprise a Cas9 mRNA. In some compositions comprising an mRNA encoding a Cas nuclease, the LNP further comprises a gRNA nucleic acid, such as a gRNA. In some embodiments, the RNA component comprises a Cas nuclease mRNA and a gRNA. In some embodiments, the RNA component comprises a Class 2 Cas nuclease mRNA and a gRNA.

In certain embodiments, an LNP composition may comprise an mRNA encoding a Cas nuclease such as a Class 2 Cas nuclease, an amine lipid, a helper lipid, a neutral lipid, and a PEG lipid. In certain LNP compositions comprising an mRNA encoding a Cas nuclease such as a Class 2 Cas nuclease, the helper lipid is cholesterol. In other compositions comprising an mRNA encoding a Cas nuclease such as a Class 2 Cas nuclease, the neutral lipid is DSPC. In additional embodiments comprising an mRNA encoding a Cas nuclease such as a Class 2 Cas nuclease, the PEG lipid is PEG2k-DMG or PEG2k-C11. In specific compositions comprising an mRNA encoding a Cas nuclease such as a Class 2 Cas nuclease, the amine lipid is selected from Lipid A and its equivalents, such as an acetal analog of Lipid A.

In some embodiments, an LNP composition may comprise a gRNA. In certain embodiments, an LNP composition may comprise an amine lipid, a gRNA, a helper lipid, a neutral lipid, and a PEG lipid. In certain LNP compositions comprising a gRNA, the helper lipid is cholesterol. In some compositions comprising a gRNA, the neutral lipid is DSPC. In additional embodiments comprising a gRNA, the PEG lipid is PEG2k-DMG or PEG2k-C11. In certain embodiments, the amine lipid is selected from Lipid A and its equivalents, such as an acetal analog of Lipid A.

In one embodiment, an LNP composition may comprise an sgRNA. In one embodiment, an LNP composition may comprise a Cas9 sgRNA. In one embodiment, an LNP composition may comprise a Cpf1 sgRNA. In some compositions comprising an sgRNA, the LNP includes an amine lipid, a helper lipid, a neutral lipid, and a PEG lipid. In certain compositions comprising an sgRNA, the helper lipid is cholesterol. In other compositions comprising an sgRNA, the neutral lipid is DSPC. In additional embodiments comprising an sgRNA, the PEG lipid is PEG2k-DMG or PEG2k-C11. In certain embodiments, the amine lipid is selected from Lipid A and its equivalents, such as acetal analogs of Lipid A.

In certain embodiments, an LNP composition comprises an mRNA disclosed herein, e.g., encoding a Cas nuclease, and a gRNA, which may be an sgRNA. In one embodiment, an LNP composition may comprise an amine lipid, an mRNA encoding a Cas nuclease, a gRNA, a helper lipid, a neutral lipid, and a PEG lipid. In certain compositions comprising an mRNA encoding a Cas nuclease and a gRNA, the helper lipid is cholesterol. In some compositions comprising an mRNA encoding a Cas nuclease and a gRNA, the neutral lipid is DSPC. In additional embodiments comprising an mRNA encoding a Cas nuclease and a gRNA, the PEG lipid is PEG2k-DMG or PEG2k-C11. In certain embodiments, the amine lipid is selected from Lipid A and its equivalents, such as acetal analogs of Lipid A.

In certain embodiments, the LNP compositions include a Cas nuclease mRNA, such as a Class 2 Cas mRNA and at least one gRNA. In certain embodiments, the LNP composition includes a ratio of gRNA to Cas nuclease mRNA, such as Class 2 Cas nuclease mRNA from about 25:1 to about 1:25. In certain embodiments, the LNP formulation includes a ratio of gRNA to Cas nuclease mRNA, such as Class 2 Cas nuclease mRNA from about 10:1 to about 1:10. In certain embodiments, the LNP formulation includes a ratio of gRNA to Cas nuclease mRNA, such as Class 2 Cas nuclease mRNA from about 8:1 to about 1:8. As measured herein, the ratios are by weight. In some embodiments, the LNP formulation includes a ratio of gRNA to Cas nuclease mRNA, such as Class 2 Cas mRNA from about 5:1 to about 1:5. In some embodiments, ratio range is about 3:1 to 1:3, about 2:1 to 1:2, about 5:1 to 1:2, about 5:1 to 1:1, about 3:1 to 1:2, about 3:1 to 1:1, about 3:1, about 2:1 to 1:1. In some embodiments, the gRNA to mRNA ratio is about 3:1 or about 2:1 In some embodiments the ratio of gRNA to Cas nuclease mRNA, such as Class 2 Cas nuclease is about 1:1. The ratio may be about 25:1, 10:1, 5:1, 3:1, 1:1, 1:3, 1:5, 1:10, or 1:25.

The LNP compositions disclosed herein may include a template nucleic acid. The template nucleic acid may be co-formulated with an mRNA encoding a Cas nuclease, such as a Class 2 Cas nuclease mRNA. In some embodiments, the template nucleic acid may be co-formulated with a guide RNA. In some embodiments, the template nucleic acid may be co-formulated with both an mRNA encoding a Cas nuclease and a guide RNA. In some embodiments, the template nucleic acid may be formulated separately from an mRNA encoding a Cas nuclease or a guide RNA. The template nucleic acid may be delivered with, or separately from the LNP compositions. In some embodiments, the template nucleic acid may be single- or double-stranded, depending on the desired repair mechanism. The template may have regions of homology to the target DNA, or to sequences adjacent to the target DNA.

Any of the LNPs and LNP formulations described herein are suitable for delivery an mRNA encoding an RNA-guided DNA binding agent such as a Cas nuclease, alone or together with one or more guide RNAs. In some embodiments, an LNP composition is encompassed comprising: an RNA component and a lipid component, wherein the lipid component comprises an amine lipi d, a neutral lipid, a helper lipid, and a stealth lipid; and wherein the N/P ratio is about 1-10.

In some instances, the lipid component comprises Lipid A or its acetal analog, cholesterol, DSPC, and PFG-DMG; and wherein the N/P ratio is about 1-10. In some embodiments, the lipid component comprises: about 40-60 mol-% amine lipid; about 5-15 mol-% neutral lipid; and about 1.5-10 mol-% PEG lipid, wherein the remainder of the lipid component is helper lipid, and wherein the N/P ratio of the LNP composition is about 3-10. In some embodiments, the lipid component comprises: about 50-60 mol-% amine lipid; about 8-10 mol-% neutral lipid; and about 2.5-4 mol-% PEG lipid, wherein the remainder of the lipid component is helper lipid, and wherein the N/P ratio of the LNP composition is about 3-8. In some instances, the lipid component comprises: about 50-60 mol-% amine lipid; about 5-15 mol-% DSPC; and about 2.5-4 mol-% PEG lipid, wherein the remainder of the lipid component is cholesterol, and wherein the N/P ratio of the LNP composition is about 3-8. In some instances, the lipid component comprises: 48-53 mol-% Lipid A; about 8-10 mol-% DSPC; and 1.5-10 mol-% PEG lipid, wherein the remainder of the lipid component is cholesterol, and wherein the N/P ratio of the LNP composition is 3-8±0.2.

In some embodiments, LNPs are formed by mixing an aqueous RNA solution with an organic solvent-based lipid solution, e.g., 100% ethanol. Suitable solutions or solvents include or may contain: water, PBS, Tris buffer, NaCl, citrate buffer, ethanol, chloroform, diethylether, cyclohexane, tetrahydrofuran, methanol, isopropanol. A pharmaceutically acceptable buffer, e.g., for in vivo administration of LNPs, may be used. In certain embodiments, a buffer is used to maintain the pH of the composition comprising LNPs at or above pH 6.5. In certain embodiments, a buffer is used to maintain the pH of the composition comprising LNPs at or above pH 7.0. In certain embodiments, the composition has a pH ranging from about 7.2 to about 7.7. In additional embodiments, the composition has a pH ranging from about 7.3 to about 7.7 or ranging from about 7.4 to about 7.6. In further embodiments, the composition has a pH of about 7.2, 7.3, 7.4, 7.5, 7.6, or 7.7. The pH of a composition may be measured with a micro pH probe. In certain embodiments, a cryoprotectant is included in the composition. Non-limiting examples of cryoprotectants include sucrose, trehalose, glycerol, DMSO, and ethylene glycol. Exemplary compositions may include up to 10% cryoprotectant, such as, for example, sucrose. In certain embodiments, the LNP composition may include about 1, 2, 3, 4, 5, 6, 7, 8, 9, or 10% cryoprotectant. In certain embodiments, the LNP composition may include about 1, 2, 3, 4, 5, 6, 7, 8, 9, or 10% sucrose. In some embodiments, the LNP composition may include a buffer. In some embodiments, the buffer may comprise a phosphate buffer (PBS), a Tris buffer, a citrate buffer, and mixtures thereof. In certain exemplary embodiments, the buffer comprises NaCl. In certain embodiments, NaCl is omitted. Exemplary amounts of NaCl may range from about 20 mM to about 45 mM. Exemplary amounts of NaCl may range from about 40 mM to about 50 mM. In some embodiments, the amount of NaCl is about 45 mM. In some embodiments, the buffer is a Tris buffer. Exemplary amounts of Tris may range from about 20 mM to about 60 mM. Exemplary amounts of Tris may range from about 40 mM to about 60 mM. In some embodiments, the amount of Tris is about 50 mM. In some embodiments, the buffer comprises NaCl and Tris. Certain exemplary embodiments of the LNP compositions contain 5% sucrose and 45 mM NaCl in Tris buffer. In other exemplary embodiments, compositions contain sucrose in an amount of about 5% w/v, about 45 mM NaCl, and about 50 mM Tris at pH 7.5. The salt, buffer, and cryoprotectant amounts may be varied such that the osmolality of the overall formulation is maintained. For example, the final osmolality may be maintained at less than 450 mOsm/L. In further embodiments, the osmolality is between 350 and 250 mOsm/L. Certain embodiments have a final osmolality of 300+/−20 mOsm/L.

In some embodiments, microfluidic mixing, T-mixing, or cross-mixing is used. In certain aspects, flow rates, junction size, junction geometry, junction shape, tube diameter, solutions, and/or RNA and lipid concentrations may be varied. LNPs or LNP compositions may be concentrated or purified, e.g., via dialysis, tangential flow filtration, or chromatography. The LNPs may be stored as a suspension, an emulsion, or a lyophilized powder, for example. In some embodiments, an LNP composition is stored at 2-8° C., in certain aspects, the LNP compositions are stored at room temperature. In additional embodiments, an LNP composition is stored frozen, for example at −20° C. or −80° C. In other embodiments, an LNP composition is stored at a temperature ranging from about 0° C. to about −80° C. Frozen LNP compositions may be thawed before use, for example on ice, at 4° C., at room temperature, or at 25° C. Frozen LNP compositions may be maintained at various temperatures, for example on ice, at 4° C., at room temperature, at 25° C., or at 37° C.

In some embodiments, an LNP composition has greater than about 80% encapsulation. In some embodiments, an LNP composition has a particle size less than about 120 nm. In some embodiments, an LNP composition has a pdi less than about 0.2. In some embodiments, at least two of these features are present. In some embodiments, each of these three features is present. Analytical methods for determining these parameters are discussed below in the general reagents and methods section.

In some embodiments, LNPs associated with an mRNA disclosed herein are for use in preparing a medicament.

Electroporation is also a well-known means for delivery of cargo, and any electroporation methodology may be used for delivery of any one of the gRNAs disclosed herein. In some embodiments, electroporation may be used to deliver an mRNA disclosed herein and one or more guide RNAs.

In some embodiments, a method is provided for delivering an mRNA disclosed herein to an ex vivo cell, wherein the mRNA is associated with an LNP or not associated with an LNP. In some embodiments, the mRNA/LNP or mRNA is also associated with one or more guide RNAs.

In some embodiments, when an mRNA disclosed herein is administered to a mammal in a pharmaceutical composition, the mammal exhibits a cytokine response at least 1.5, 2, 2.5, 3, 3.5, 4, 4.5, 5, 5.5, 6, 7, 7.5, 8, 8.5, 9, 9.5, or 10 times lower than a mammal administered an mRNA encoding a Cas9 nuclease with greater than 150% of the minimum uridine content. A cytokine response may be determined as described in the Examples. A difference between cytokine responses can be measured as the average change in a panel of cytokines such as at, least one, two, three, or four of the following cytokines: IFN alpha, IL-6, TNF alpha, and MCP-1. In some embodiments, when an mRNA disclosed herein is administered to a mammal in a pharmaceutical composition, the mammal exhibits a cytokine response at least 1.5, 2, 2.5, 3, 3.5, 4, 4.5, 5, 5.5, 6, 7, 7.5, 8, 8.5, 9, 9.5, or 10 times lower than a mammal administered an mRNA having an ORF encoding a Cas9 nuclease, wherein the sequence of the ORF consists of SEQ ID NO: 5. In some embodiments, the uridines in the ORF with a sequence consisting of SEQ ID NO: 5 are unmodified. It is generally understood that the features of the comparative composition other than the mRNA should be held constant, including the dose, and that the dose should be in an appropriate range such as 0.1-5 mpk or other ranges described herein (e.g., as discussed in the Determination of Efficacy of mRNA section).

In some embodiments, the nucleotide sequence encoding the guide RNA may be located on the same vector, transcript, or mRNA comprising the nucleotide sequence encoding the RNA-guided DNA-binding agent. In some embodiments, expression of the guide RNA and of the RNA-guided DNA-binding agent may be driven by their own corresponding promoters. In some embodiments, expression of the guide RNA may be driven by the same promoter that drives expression of the RNA-guided DNA-binding agent. In some embodiments, the guide RNA and the ORF encoding the RNA-guided DNA-binding agent may be contained within a single transcript. For example, the guide RNA may be within an untranslated region (UTR) of the RNA-guided DNA-binding agent transcript. In some embodiments, the guide RNA may be within the 5' UTR of the RNA-guided DNA-binding agent transcript. In other embodiments, the guide RNA may be within the 3' UTR of the RNA-guided DNA-binding agent transcript. In some embodiments, the intracellular half-life of the RNA-guided DNA-binding agent transcript may be reduced by containing the guide RNA within its 3' UTR and thereby shortening the length of its 3' UTR. In additional embodiments, the guide RNA may be within an intron of the RNA-guided DNA-binding agent transcript. In some embodiments, suitable splice sites may be added at the intron within which the guide RNA is located such that the guide RNA is properly spliced out of the transcript. In some embodiments, expression of the RNA-guided DNA-binding agent and the guide RNA in close proximity on the same vector may facilitate more efficient formation of a ribonucleoprotein complex of the RNA-guided DNA-binding agent with the guide RNA.

In some embodiments, a pharmaceutical formulation comprising an mRNA according to the disclosure is provided. In some embodiments, a pharmaceutical formulation comprising at least one lipid, for example, an LNP which comprises an mRNA according to the disclosure, is provided. Any LNP suitable for delivering RNA can be used, such as those described above; additional exemplary LNPs are described in PCT/US2017/024973, filed Mar. 30, 3017. A pharmaceutical formulation can further comprise a pharmaceutically acceptable carrier, e.g., water or a buffer. A pharmaceutical formulation can further comprise one or more pharmaceutically acceptable excipients, such as a stabilizer, preservative, bulking agent, or the like. A pharmaceutical formulation can further comprise one or more pharmaceutically acceptable salts, such as sodium chloride. In some embodiments, the pharmaceutical formulation is formulated for intravenous administration. In some embodiments, the pharmaceutical formulation is formulated for delivery into the hepatic circulation.

C. Determination of Efficacy of mRNA

In some embodiments, the efficacy of an mRNA is determined when expressed together with other components of an RNP, e.g., at least one gRNA, such as a gRNA targeting TTR.

An RNA-guided DNA-binding agent with cleavase activity can lead to double-stranded breaks in the DNA. Nonhomologous end joining (NHEJ) is a process whereby double-stranded breaks (DSBs) in the DNA are repaired via re-ligation of the break ends, which can produce errors in the form of insertion/deletion (indel) mutations. The DNA ends of a DSB are frequently subjected to enzymatic processing, resulting in the addition or removal of nucleotides at one or both strands before the rejoining of the ends. These additions or removals prior to rejoining result in the presence of insertion or deletion (indel) mutations in the DNA sequence at the site of the NHEJ repair. Many mutations due to indels alter the reading frame or introduce premature stop codons and, therefore, produce a non-functional protein.

In some embodiments, the efficacy of an mRNA encoding a nuclease is determined based on in vitro models. In some embodiments, the in vitro model is HEK293 cells. In some embodiments, the in vitro model is HUH7 human hepatocarcinoma cells. In some embodiments, the in vitro model is primary hepatocytes, such as primary human or mouse hepatocytes.

In some embodiments, the efficacy of an RNA is measured by percent editing of TTR. Exemplary procedures for determining percent editing are given in the Examples below. In some embodiments, the percent editing of TTR is compared to the percent editing obtained when the mRNA comprises an ORF of SEQ ID NO: 5 with unmodified uridine and all else is equal.

In some embodiments, the efficacy of an mRNA is determined using serum TTR concentration in a mouse following administration of an LNP comprising the mRNA and a gRNA targeting TTR, e.g., SEQ ID NO: 42. In some embodiments, the efficacy of an mRNA is determined using serum TTR concentration in a rat following administration of an LNP comprising the mRNA and a gRNA targeting TTR, e.g., SEQ ID NO: 69. The serum TTR concentration can be expressed in absolute terms or in % knockdown relative to a sham-treated control. In some embodiments, the efficacy of an mRNA is determined using percentage editing in the liver in a mouse following administration of an LNP comprising the mRNA and a gRNA targeting TTR, e.g., SEQ ID NO: 42. In some embodiments, an effective amount is able to achieve at least 50% editing or 50% knockdown of serum TTR. Exemplary effective amounts are in the range of 0.1 to 10 mg/kg (mpk), e.g., 0.1 to 0.3 mpk, 0.3 to 0.5 mpk, 0.5 to 1 mpk, 1 to 2 mpk, 2 to 3 mpk, 3 to 5 mpk, 5 to 10 mpk, or 0.1, 0.2, 0.3, 0.5, 1, 2, 3, 5, or 10 mpk.

In some embodiments, detecting gene editing events, such as the formation of insertion/deletion ("indel") mutations and homology directed repair (HDR) events in target DNA utilize linear amplification with a tagged primer and isolating the tagged amplification products (herein after referred to as "LAM-PCR," or "Linear Amplification (LA)" method).

In some embodiments, the method comprises isolating cellular DNA from a cell that has been induced to have a double strand break (DSB) and optionally that has been provided with an HDR template to repair the DSB; performing at least one cycle of linear amplification of the DNA with a tagged primer; isolating the linear amplification products that comprise tag, thereby discarding any amplification product that was amplified with a non-tagged primer; optionally further amplifying the isolated products; and analyzing the linear amplification products, or the further amplified products, to determine the presence or absence of an editing event such as, for example, a double strand break, an insertion, deletion, or HDR template sequence in the target DNA. In some instances, the editing event can be quantified. Quantification and the like as used herein (including in the context of HDR and non-HDR editing events such as indels) includes detecting the frequency and/or type(s) of editing events in a population In some embodiments, only one cycle of linear amplification is conducted.

In some instances, the tagged primer comprises a molecular barcode. In some embodiments, the tagged primer comprises a molecular barcode, and only one cycle of linear amplification is conducted.

In some embodiments, the analyzing step comprises sequencing the linear amplified products or the further amplified products. Sequencing may comprise any method known to those of skill in the art, including, next generation sequencing, and cloning the linear amplification products or further amplified products into a plasmid and sequencing the plasmid or a portion of the plasmid. In other aspects, the analyzing step comprises performing digital PCR (dPCR) or droplet digital PCR (ddPCR) on the linear amplified products or the further amplified products. In other instances, the analyzing step comprises contacting the linear amplified products or the further amplified products with a nucleic acid probe designed to identify DNA comprising HDR template sequence and detecting the probes that have bound to the linear amplified product(s) or further amplified product(s). In some embodiments, the method further comprises determining the location of the HDR template in the target DNA.

In certain embodiments, the method further comprises determining the sequence of an insertion site in the target DNA, wherein the insertion site is the location where the HDR template incorporates into the target DNA, and wherein the insertion site may include some target DNA sequence and some HDR template sequence.

In some embodiments, the linear amplification of the target DNA with a tagged primer is performed for 1-50 cycles, 1-60 cycles, 1-70 cycles, 1-80 cycles, 1-90 cycles, or 1-100 cycles.

In some embodiments, the linear amplification of the target DNA with a tagged primer comprises a denaturation step to separate DNA duplexes, an annealing step to allow primer binding, and an elongation step. In some embodiments, the linear amplification is isothermal (does not require a change in temperature). In some embodiments, the isothermal linear amplification is a loop-mediated isothermal amplification (LAMP), a strand displacement amplification (SDA), a helicase-dependent amplification, or a nicking enzyme amplification reaction.

In some embodiments, the tagged primer anneals to the target DNA at least 50, at least 60, at least 70, at least 80, at least 90, at least 100, at least 110, at least 120, at least 130, at least 140, at least 150, at least 160, at least 170, at least 180, at least 190, at least 200, at least 210, at least 220, at least 230, at least 240, at least 250, at least 260, at least 270, at least 280, at least 290, at least 300, at least 1,000, at least 5,000, or at least 10,000 nucleotides away from of the expected editing event location, e.g., the insertion, deletion, or template insertion site.

In some embodiments, the tagged primer comprises a molecular barcode. In some embodiments, the molecular barcode comprises a sequence that is not complementary to the target DNA In some embodiments, the molecular barcode comprises 6, 8, 10, or 12 nucleotides.

In some embodiments, the tag on the primer is biotin, streptavidin, digoxigenin, a DNA sequence, or fluorescein isothiocyanate (FITC).

In some embodiments, the linear amplification product(s) are isolated using a capture reagent specific for the tag on the primer. In some embodiments, the capture reagent is on a bead, solid support, matrix, or column. In some embodiments, the isolation step comprises contacting the linear amplification product(s) with a capture reagent specific for the tag on the primer. In some embodiments, the capture reagent is biotin, streptavidin, digoxigenin, a DNA sequence, or fluorescein isothiocyanate (FITC).

In some embodiments, the tag is biotin and capture reagent is streptavidin. In some embodiments, the tag is streptavidin and the capture reagent is biotin. In some embodiments, the tag is on the 5' terminus of the primer, the 3' terminus of the primer, or internal to the primer. In some embodiments, the tag and/or the capture reagent is removed after the isolation step. In some embodiments, the tag and/or the capture reagent is not removed, and the further amplifying and analyzing steps are performed in the presence of tag and/or capture.

In some embodiments, the further amplification is non-linear. In some embodiments, the further amplification is digital PCR, qPCR, or RT-PCR. In some embodiments, the sequencing is next generation sequencing (NGS).

In some embodiments, the target DNA is genomic or mitochondrial. In some embodiments, the target DNA is genomic DNA of a prokaryotic or eukaryotic cell. In some embodiments, the target DNA is mammalian. The target DNA may be from a non-dividing cell or a dividing cell. In some embodiments, the target DNA may be from a primary cell. In some embodiments, the target DNA is from a replicating cell.

In some instances, the cellular DNA is sheared prior to linear amplification. In some embodiments, the sheared DNA has an average size between 0.5 kb and 20 kb. In some instances, the cellular DNA is sheared to an average size of 0.5, 0.75, 1.0, 1.25, 1.5, 1.75, 2.0, 2.25, 2.5, 2.75, 3.0, 3.25, 3.5, 3.75, 4.0, 4.25, 4.5, 4.75, 5.0, 5.25, 5.5, 5.75, 6.0, 6.25, 6.5, 6.75, 7.0, 7.25, 7.5, 7.75, 8.0, 8.25, 8.5, 8.75, 9.0, 9.25, 9.5, 9.75, 10.0, 10.25, 10.5, 10.75, 11.0, 11.25, 11.5, 11.75, 12.0, 12.25, 12.5, 12.75, 13.0, 13.25, 13.5, 13.75, 14.0, 14.25, 14.5, 14.75, 15.0, 15.25, 15.5, 15.75, 16.0, 16.25, 16.5, 16.75, 17.0, 17.25, 17.5, 17.75, 18.0, 18.25, 18.5, 18.75, 19.0, 19.25, 19.5, 19.75, or 20.0 kb. In some instances, the cellular DNA is sheared to an average size of about 1.5 kb.

D. Exemplary Uses, Methods, and Treatments

In some embodiments, an mRNA, LNP, or pharmaceutical composition is for use in genome editing, e.g., editing a target gene. In some embodiments, an mRNA, LNP, or pharmaceutical composition is for use in modifying a target gene, e.g., altering its sequence or epigenetic status. In some embodiments, an mRNA, LNP, or pharmaceutical composition is for use in inducing a double-stranded break (DSB) within a target gene. In some embodiments, an mRNA, LNP, or pharmaceutical composition is for use in inducing an indel within a target gene. In some embodiments, the use of an mRNA, LNP, or pharmaceutical composition disclosed herein is provided for the preparation of a medicament for genome editing, e.g., editing a target gene. In some embodiments, the use of an mRNA, LNP, or pharmaceutical composition disclosed herein is provided for the preparation of a medicament for modifying a target gene, e.g., altering its sequence or epigenetic status. In some embodiments, the use of an mRNA, LNP, or pharmaceutical composition disclosed herein is provided for the preparation of a medicament for inducing a double-stranded break (DSB) within a target gene. In some embodiments, the use of an mRNA, LNP, or pharmaceutical composition disclosed herein is provided for the preparation of a medicament for inducing an indel within a target gene. In some embodiments, the target gene is in a subject, such as a mammal, such as a human. In some embodiments, the target gene is in an organ, such as a liver, such as a mammalian liver, such as a human liver. In some embodiments, the target gene is in a liver cell, such as a mammalian liver cell, such as a human liver cell. In some embodiments, the target gene is in a hepatocyte, such as a mammalian hepatocyte, such as a human hepatocyte. In some embodiments, the liver cell or hepatocyte is in situ. In some embodiments, the liver cell or hepatocyte is isolated, e.g., in a culture, such as in a primary culture. Also provided are methods corresponding to the uses disclosed herein, which comprise administering the mRNA, LNP, or pharmaceutical composition disclosed herein to a subject or contacting a cell such as those described above with the mRNA, LNP, or pharmaceutical composition disclosed herein.

In some embodiments, an mRNA, LNP, or pharmaceutical composition is for use in therapy or in treating a disease, e.g., amyloidosis associated with TTR (ATTR). In some embodiments, the use of an mRNA disclosed herein (e.g., in a composition provided herein) is provided for the preparation of a medicament, e.g., for treating a subject having amyloidosis associated with TTR (ATTR).

In some embodiments, an mRNA, LNP, or pharmaceutical composition is administered intravenously for any of the uses discussed above concerning organisms, organs, or cells in situ. In some embodiments, an mRNA, LNP, or pharmaceutical composition is administered at a dose in the range of 0.01 to 10 mg/kg (mpk), e.g., 0.01 to 0.1 mpk, 0.1 to 0.3 mpk, 0.3 to 0.5 mpk, 0.5 to 1 mpk, 1 to 2 mpk, 2 to 3 mpk, 3 to 5 mpk, 5 to 10 mpk, or 0.1, 0.2, 0.3, 0.5, 1, 2, 3, 5, or 10 mpk.

In any of the foregoing embodiments involving a subject, the subject can be mammalian. In any of the foregoing embodiments involving a subject, the subject can be human. In any of the foregoing embodiments involving a subject, the subject can be a cow, pig, monkey, sheep, dog, cat, fish, or poultry.

In some embodiments, a mRNA, LNP, or pharmaceutical composition disclosed herein is administered intravenously or for intravenous administration. In some embodiments, the guide RNAs, compositions, and formulations are administered into the hepatic circulation or for administration into the hepatic circulation.

In some embodiments, a single administration of a mRNA, LNP, or pharmaceutical composition disclosed herein is sufficient to knock down expression of the target gene product. In some embodiments, a single administration of a mRNA, LNP, or pharmaceutical composition disclosed herein is sufficient to knock out expression of the target gene product. In other embodiments, more than one administration of a mRNA, LNP, or pharmaceutical composition disclosed herein may be beneficial to maximize editing, modification, indel formation, DSB formation, or the like via cumulative effects.

In some embodiments, the efficacy of treatment with a mRNA, LNP, or pharmaceutical composition disclosed herein is seen at 1 year, 2 years, 3 years, 4 years, 5 years, or 10 years after delivery.

In some embodiments, treatment slows or halts disease progression.

In some embodiments, treatment results in improvement, stabilization, or slowing of change in organ function or symptoms of disease of an organ, such as the liver.

In some embodiments, efficacy of treatment is measured by increased survival time of the subject.

E. Exemplary DNA Molecules, Vectors, Expression Constructs, Host Cells, and Production Methods In certain embodiments, the disclosure provides a DNA molecule comprising a sequence encoding any of the mRNAs encoding an RNA-guided DNA-binding agent described herein. In some embodiments, in addition to RNA-guided DNA-binding agent sequences, the DNA molecule further comprises nucleic acids that do not encode RNA-guided DNA-binding agents. Nucleic acids that do not encode RNA-guided DNA-binding agents include, but are not limited to, promoters, enhancers, regulatory sequences, and nucleic acids encoding a guide RNA.

In some embodiments, the DNA molecule further comprises a nucleotide sequence encoding a crRNA, a trRNA, or a crRNA and trRNA. In some embodiments, the nucleotide sequence encoding the crRNA, trRNA, or crRNA and trRNA comprises or consists of a guide sequence flanked by all or a portion of a repeat sequence from a naturally-occurring CRISPR/Cas system. The nucleic acid comprising or consisting of the crRNA, trRNA, or crRNA and trRNA may further comprise a vector sequence wherein the vector sequence comprises or consists of nucleic acids that are not naturally found together with the crRNA, trRNA, or crRNA and trRNA. In some embodiments, the crRNA and the trRNA are encoded by non-contiguous nucleic acids within one vector. In other embodiments, the crRNA and the trRNA may be encoded by a contiguous nucleic acid. In some embodiments, the crRNA and the trRNA are encoded by opposite strands of a single nucleic acid. In other embodiments, the crRNA and the trRNA are encoded by the same strand of a single nucleic acid.

In some embodiments, the DNA molecule further comprises a promoter operably linked to the sequence encoding any of the mRNAs encoding an RNA-guided DNA-binding agent described herein. In some embodiments, the DNA molecule is an expression construct suitable for expression in a mammalian cell, e.g., a human cell or a mouse cell, such as a human hepatocyte or a rodent (e.g., mouse) hepatocyte. In some embodiments, the DNA molecule is an expression construct suitable for expression in a cell of a mammalian organ, e.g., a human liver or a rodent (e.g., mouse) liver. In some embodiments, the DNA molecule is a plasmid or an episome. In some embodiments, the DNA molecule is contained in a host cell, such as a bacterium or a cultured eukaryotic cell. Exemplary bacteria include proteobacteria such as E. coli. Exemplary cultured eukaryotic cells include primary hepatocytes, including hepatocytes of rodent (e.g., mouse) or human origin; hepatocyte cell lines, including hepatocytes of rodent (e.g., mouse) or human origin; human cell lines; rodent (e.g., mouse) cell lines; CHO cells; microbial fungi, such as fission or budding yeasts, e.g., Saccharomyces, such as S. cerevisiae; and insect cells.

In some embodiments, a method of producing an mRNA disclosed herein is provided. In some embodiments, such a method comprises contacting a DNA molecule described herein with an RNA polymerase under conditions permissive for transcription. In some embodiments, the contacting is performed in vitro, e.g., in a cell-free system. In some embodiments, the RNA polymerase is an RNA polymerase of bacteriophage origin, such as T7 RNA polymerase. In some embodiments, NTPs are provided that include at least one modified nucleotide as discussed above. In some embodiments, the NTPs include at least one modified nucleotide as discussed above and do not comprise UTP.

In some embodiments, an mRNA disclosed herein alone or together with one or more guide RNAs, may be comprised within or delivered by a vector system of one or more vectors. In some embodiments, one or more of the vectors, or all of the vectors, may be DNA vectors. In some embodiments, one or more of the vectors, or all of the vectors, may be RNA vectors. In some embodiments, one or more of the vectors, or all of the vectors, may be circular. In other embodiments, one or more of the vectors, or all of the vectors, may be linear. In some embodiments, one or more of the vectors, or all of the vectors, may be enclosed in a lipid nanoparticle, liposome, non-lipid nanoparticle, or viral capsid. Non-limiting exemplary vectors include plasmids, phagemids, cosmids, artificial chromosomes, minichromosomes, transposons, viral vectors, and expression vectors.

Non-limiting exemplary viral vectors include adeno-associated virus (AAV) vector, lentivirus vectors, adenovirus vectors, helper dependent adenoviral vectors (HDAd), herpes simplex virus (HSV-1) vectors, bacteriophage T4, baculovirus vectors, and retrovirus vectors. In some embodiments, the viral vector may be an AAV vector. In other embodiments, the viral vector may a lentivirus vector. In some embodiments, the lentivirus may be non-integrating. In some embodiments, the viral vector may be an adenovirus vector. In some embodiments, the adenovirus may be a high-cloning capacity or "gutless" adenovirus, where all coding viral regions apart from the 5' and 3' inverted terminal repeats (ITRs) and the packaging signal (T) are deleted from the virus to increase its packaging capacity. In yet other embodiments, the viral vector may be an HSV-1 vector. In some embodiments, the HSV-1-based vector is helper dependent, and in other embodiments it is helper independent. For example, an amplicon vector that retains only the packaging sequence requires a helper virus with structural components for packaging, while a 30 kb-deleted HSV-1 vector that removes non-essential viral functions does not require helper virus. In additional embodiments, the viral vector may be bacteriophage T4. In some embodiments, the bacteriophage T4 may be able to package any linear or circular DNA or RNA molecules when the head of the virus is emptied. In further embodiments, the viral vector may be a baculovirus vector. In yet further embodiments, the viral vector may be a retrovirus vector. In embodiments using AAV or lentiviral vectors, which have smaller cloning capacity, it may be necessary to use more than one vector to deliver all the components of a vector system as disclosed herein. For example, one AAV vector may contain sequences encoding a Cas protein, while a second AAV vector may contain one or more guide sequences.

In some embodiments, the vector may be capable of driving expression of one or more coding sequences, such as the coding sequence of an mRNA disclosed herein, in a cell. In some embodiments, the cell may be a prokaryotic cell, such as, e.g., a bacterial cell. In some embodiments, the cell may be a eukaryotic cell, such as, e.g., a yeast, plant, insect, or mammalian cell. In some embodiments, the eukaryotic cell may be a mammalian cell. In some embodiments, the eukaryotic cell may be a rodent cell. In some embodiments, the eukaryotic cell may be a human cell. Suitable promoters to drive expression in different types of cells are known in the art. In some embodiments, the promoter may be wild type. In other embodiments, the promoter may be modified for more efficient or efficacious expression. In yet other embodiments, the promoter may be truncated yet retain its function. For example, the promoter may have a normal size or a reduced size that is suitable for proper packaging of the vector into a virus.

In some embodiments, the vector system may comprise one copy of a nucleotide sequence encoding an RNA-guided DNA-binding agent. In other embodiments, the vector system may comprise more than one copy of a nucleotide sequence encoding an RNA-guided DNA-binding agent. In some embodiments, the nucleotide sequence encoding the RNA-guided DNA-binding agent may be operably linked to at least one transcriptional or translational control sequence. In some embodiments, the nucleotide sequence encoding the nuclease may be operably linked to at least one promoter.

In some embodiments, the promoter may be constitutive, inducible, or tissue-specific. In some embodiments, the promoter may be a constitutive promoter. Non-limiting exemplary constitutive promoters include cytomegalovirus immediate early promoter (CMV), simian virus (SV40)

promoter, adenovirus major late (MLP) promoter, Rous sarcoma virus (RSV) promoter, mouse mammary tumor virus (MMTV) promoter, phosphoglycerate kinase (PGK) promoter, elongation factor-alpha (EF1a) promoter, ubiquitin promoters, actin promoters, tubulin promoters, immunoglobulin promoters, a functional fragment thereof, or a combination of any of the foregoing. In some embodiments, the promoter may be a CMV promoter. In some embodiments, the promoter may be a truncated CMV promoter. In other embodiments, the promoter may be an EF1a promoter. In some embodiments, the promoter may be an inducible promoter. Non-limiting exemplary inducible promoters include those inducible by heat shock, light, chemicals, peptides, metals, steroids, antibiotics, or alcohol. In some embodiments, the inducible promoter may be one that has a low basal (non-induced) expression level, such as, e.g., the Tet-On® promoter (Clontech).

In some embodiments, the promoter may be a tissue-specific promoter, e.g., a promoter specific for expression in the liver.

The vector may further comprise a nucleotide sequence encoding at least one guide RNA. In some embodiments, the vector comprises one copy of the guide RNA. In other embodiments, the vector comprises more than one copy of the guide RNA. In embodiments with more than one guide RNA, the guide RNAs may be non-identical such that they target different target sequences, or may be identical in that they target the same target sequence. In some embodiments where the vectors comprise more than one guide RNA, each guide RNA may have other different properties, such as activity or stability within a ribonucleoprotein complex with the RNA-guided DNA-binding agent. In some embodiments, the nucleotide sequence encoding the guide RNA may be operably linked to at least one transcriptional or translational control sequence, such as a promoter, a 3' UTR, or a 5' UTR. In one embodiment, the promoter may be a tRNA promoter, e.g., tRNA$^{Lys3}$, or a tRNA chimera. See Mefferd et al., *RNA*. 2015 21:1683-9; Scherer et al., *Nucleic Acids Res*. 2007 35: 2620-2628. In some embodiments, the promoter may be recognized by RNA polymerase III (Pol III). Non-limiting examples of Pol III promoters include U6 and H1 promoters. In some embodiments, the nucleotide sequence encoding the guide RNA may be operably linked to a mouse or human U6 promoter. In other embodiments, the nucleotide sequence encoding the guide RNA may be operably linked to a mouse or human H1 promoter. In embodiments with more than one guide RNA, the promoters used to drive expression may be the same or different. In some embodiments, the nucleotide encoding the crRNA of the guide RNA and the nucleotide encoding the trRNA of the guide RNA may be provided on the same vector. In some embodiments, the nucleotide encoding the crRNA and the nucleotide encoding the trRNA may be driven by the same promoter. In some embodiments, the crRNA and trRNA may be transcribed into a single transcript. For example, the crRNA and trRNA may be processed from the single transcript to form a double-molecule guide RNA. Alternatively, the crRNA and trRNA may be transcribed into a single-molecule guide RNA. In other embodiments, the crRNA and the trRNA may be driven by their corresponding promoters on the same vector. In yet other embodiments, the crRNA and the trRNA may be encoded by different vectors.

In some embodiments, the compositions comprise a vector system, wherein the system comprises more than one vector. In some embodiments, the vector system may comprise one single vector. In other embodiments, the vector system may comprise two vectors. In additional embodiments, the vector system may comprise three vectors. When different guide RNAs are used for multiplexing, or when multiple copies of the guide RNA are used, the vector system may comprise more than three vectors.

In some embodiments, the vector system may comprise inducible promoters to start expression only after it is delivered to a target cell. Non-limiting exemplary inducible promoters include those inducible by heat shock, light, chemicals, peptides, metals, steroids, antibiotics, or alcohol. In some embodiments, the inducible promoter may be one that has a low basal (non-induced) expression level, such as, e.g., the Tet-On® promoter (Clontech).

In additional embodiments, the vector system may comprise tissue-specific promoters to start expression only after it is delivered into a specific tissue.

EXAMPLES

The following examples are provided to illustrate certain disclosed embodiments and are not to be construed as limiting the scope of this disclosure in any way.

General Reagents and Methods. Unless otherwise indicated, mRNA was synthesized by in vitro transcription (IVT) using a linearized plasmid DNA template and T7 RNA polymerase. Transcription was generally performed from constructs comprising a T7 Promoter, a transcript sequence disclosed herein such as SEQ ID NO: 43 (which comprises SEQ ID NO: 1 and encodes the RNA ORF of SEQ ID NO: 4) or SEQ ID NO: 48 (which comprises SEQ ID NO: 2 and encodes the RNA ORF of SEQ ID NO: 5), and a poly-A tail (SEQ ID NO: 63) encoded in the plasmid. Experiments in which multiple UTRs were tested used similar constructs except that transcript sequences such as SEQ ID NOs: 58 and 59 were used. Plasmid DNA containing a T7 promoter and a 100 nt poly(A/T) region was linearized by incubating at 37° C. for 2 hrs with XbaI with the following conditions: 200 ng/µL plasmid, 2 U/µL XbaI (NEB), and 1×reaction buffer. The XbaI was inactivated by heating the reaction at 65° C. for 20 min. The linearized plasmid was purified from enzyme and buffer salts using a silica maxi spin column (Epoch Life Sciences) and analyzed by agarose gel to confirm linearization. The IVT reaction to generate Cas9 modified mRNA was incubated at 37° C. for 4 hours in the following conditions: 50 ng/µL linearized plasmid; 2 mM each of GTP, ATP, CTP, and UTP or, where indicated, a modified nucleotide triphosphate (e.g., N1-methyl pseudo-UTP) in place of CTP or UTP (Trilink); 10 mM ARCA (Trilink); 5 U/µL T7 RNA polymerase (NEB); 1 U/µL Murine RNase inhibitor (NEB); 0.004 U/µL Inorganic *E. coli* pyrophospliatase (NEB); and 1×reaction buffer. After the 4 hr incubation, TURBO DNase (ThennoFisher) was added to a final concentration of 0.01 U/µL, and the reaction was incubated for an additional 30 minutes to remove the DNA template. The Cas9 mRNA was purified from enzyme and nucleotides using a MegaClear Transcription Clean-up kit according to the manufacturer's protocol (ThermoFisher). Alternatively, the mRNA was purified through a precipitation protocol, which in some cases was followed by HPLC-based purification. Briefly, after the DNase digestion, the mRNA was precipitated by adding 0.21× vol of a 7.5 M LiCl solution and mixing, and the precipitated mRNA was pelleted by centrifugation. Once the supernatant was removed, the mRNA was reconstituted in water. The mRNA was precipitated again using ammonium acetate and ethanol. 5M Ammonium acetate was added to the mRNA solution for a final concentration of 2M along with 2×volume of 100% EtOH. The solution was mixed and incubated at −20° C. for 15 min. The precipitated mRNA was again pelleted by centrifugation, the supernatant was removed, and the mRNA was reconstituted in water. As a final step, the mRNA was precipitated using sodium acetate and ethanol. 1/10 volume of 3 M sodium acetate (pH 5.5) was added to the solution along with 2×volume of 100% EtOH. The solution was mixed and incubated at −20° C. for 15 min. The precipitated mRNA was again pelleted by centrifugation, the supernatant was removed, the pellet was washed with 70% cold ethanol and allowed to air dry. The mRNA was reconstituted in water. For HPLC purified mRNA, after the LiCl precipitation and reconstitution, the mRNA was purified by RP-IP HPLC (see, e.g., Kariko, et al. *Nucleic Acids Research*, 2011, Vol. 39, No. 21 e142). The fractions chosen for pooling were combined and desalted by sodium acetate/ethanol precipitation as described above.

For all methods, the transcript concentration was determined by measuring the light absorbance at 260 nm (Nanodrop), and the transcript was analyzed by capillary electrophoresis by Bioanlayzer (Agilent).

Unless otherwise indicated, in vivo editing experiments were performed with CD-1 female mice and Sprague-Dawley rats from Charles River Laboratories. Unless otherwise indicated, analysis of serum TTR levels in mice was performed as follows. Blood was collected and the serum was isolated as indicated.

Where indicated in the applicable example, cytokine induction in the treated mice was also measured. For this analysis, approximately 50-100 µL of blood was collected by tail vein nick for serum cytokine measurements. Blood was allowed to clot at room temperature for approximately 2 hours, and then centrifuged at 1000×g for 10 minutes before collecting the serum. A Luminex based magnetic bead multiplex assay (Affymetrix ProcartaPlus, catalog number Exp040-00000-801) measuring IL-6, TNF-alpha, IFN-alpha, and MCP-1 was used for cytokine analysis in collected in samples. Kit reagents and standards were prepared as directed in the manufacturer's protocol. Mouse serum was diluted 4-fold using the sample diluent provided and 50 µL was added to wells containing 50 µL of the diluted antibody coated magnetic beads. The plate was incubated for 2 hours at room temperature and then washed. Diluted biotin antibody (50 µL) was added to the beads and incubated for 1 hour at room temperature. The beads were washed again before adding 50 µL of diluted streptavidin-PE to each well, followed by incubation for 30 minutes. The beads were washed once again and then suspended in 100 µL of wash buffer and read on the Bio-Plex 200 instrument (Bio-Rad). The data was analyzed using Bioplex Manager ver. 6.1 analysis package with cytokine concentrations calculated off a standard curve using a five parameter logistic curve fit.

Unmodified ATP, GTP, CTP, and UTP were used unless otherwise indicated. All mRNAs encoded one nuclear localization signal unless otherwise indicated.

LNPs were formed either by microfluidic mixing of the lipid and RNA solutions using a Precision Nanosystems NanoAssemblr™ Benchtop Instrument, per the manufacturer's protocol, or cross-flow mixing, as described below. Unless otherwise indicated, the LNPs contained 45% Lipid A, 9% DSPC, 44% cholesterol, and 2% PEG2k-DMG and an N:P ratio of 4.5.

LNP Formulation—NanoAssemblr

In general, the lipid nanoparticle components were dissolved in 100% ethanol with the lipid component of various molar ratios. The RNA cargos were dissolved in 25 mM citrate, 100 mM NaCl, pH 5.0, resulting in a concentration of RNA cargo of approximately 0.45 mg/mL. The LNPs were formulated with a lipid amine to RNA phosphate (N:P) molar ratio of about 4.5 or about 6, with the ratio of mRNA to gRNA at 1:1 by weight.

The LNPs were formed by microfluidic mixing of the lipid and RNA solutions using a Precision Nanosystems NanoAssemblr Benchtop Instrument, according to the manufacturer's protocol. A 2:1 ratio of aqueous to organic solvent was maintained during mixing using differential flow rates. After mixing, the LNPs were collected, diluted in water (approximately 1:1 v/v), held for 1 hour at room temperature, and further diluted with water (approximately 1:1 v/v) before final buffer exchange. The final buffer exchange into 50 mM Tris, 45 mM NaCl, 5% (w/v) sucrose, pH 7.5 (TSS) was completed with PD-10 desalting columns (GE). If required, formulations were concentrated by centrifugation with Amicon 100 kDa centrifugal filters (Millipore). The resulting mixture was then filtered using a 0.2 µm sterile filter. The final LNP was stored at −80° C. until further use.

LNP Formulation—Cross Flow

For LNPs prepared using the cross-flow technique, the LNPs were formed by impinging jet mixing of the lipid in ethanol with two volumes of RNA solutions and one volume of water. The lipid in ethanol is mixed through a mixing cross with the two volumes of RNA solution. A fourth stream of water is mixed with the outlet stream of the cross through an inline tee. (See WO2016010840 FIG. 2.) The LNPs were held for 1 hour at room temperature, and further diluted with water (approximately 1:1 v/v). Diluted LNPs were concentrated using tangential flow filtration on a flat sheet cartridge (Sartorius, 100 kD MWCO) and then buffer exchanged by diafiltration into 50 mM Tris, 45 mM NaCl, 5% (w/v) sucrose, pH 7.5 (TSS). Alternatively, the final buffer exchange into TSS was completed with PD-10 desalting columns (GE). If required, formulations were concentrated by centrifugation with Amicon 100 kDa centrifugal filters (Millipore). The resulting mixture was then filtered using a 0.2 µm sterile filter. The final LNP was stored at 4° C. or −80° C. until further use.

Formulation Analytics

Dynamic Light Scattering ("DLS") is used to characterize the polydispersity index ("pdi") and size of the LNPs of the present disclosure. DLS measures the scattering of light that results from subjecting a sample to a light source. PDI, as determined from DLS measurements, represents the distribution of particle size (around the mean particle size) in a population, with a perfectly uniform population having a PDI of zero. Average particle size and polydispersity are measured by dynamic light scattering (DLS) using a Malvern Zetasizer DLS instrument. LNP samples were diluted 30× in PBS prior to being measured by DLS. Z-average diameter which is an intensity based measurement of average particle size was reported along with number average diameter and pdi. A Malvern Zetasizer instrument is also used to measure the zeta potential of the LNP. Samples are diluted 1:17 (50 uL into 800 uL) in 0.1×PBS, pH 7.4 prior to measurement.

A fluorescence-based assay (Ribogreen®, ThermoFisher Scientific) is used to determine total RNA concentration and free RNA. Encapsulation efficiency is calclulated as (Total RNA−Free RNA)/Total RNA. LNP samples are diluted appropriately with 1× TE buffer containing 0.2% Triton-X 100 to determine total RNA or 1×TE buffer to determine free RNA. Standard curves are prepared by utilizing the starting RNA solution used to make the formulations and diluted in 1×TE buffer+/−0.2% Triton-X 100. Diluted RiboGreen® dye (according to the manufacturer's instructions) is then added to each of the standards and samples and allowed to incubate for approximately 10 minutes at room temperature, in the absence of light. A SpectraMax M5 Microplate Reader (Molecular Devices) is used to read the samples with excitation, auto cutoff and emission wavelengths set to 488 nm, 515 nm, and 525 nm respectively. Total RNA and free RNA are determined from the appropriate standard curves.

Encapsulation efficiency is calclulated as (Total RNA–Free RNA)/Total RNA. The same procedure may be used for determining the encapsulation efficiency of a DNA-based cargo component. For single-strand DNA Oligreen Dye may be used, and for double-strand DNA, Picogreen Dye.

Typically, when preparing LNPs, encapsulation was >80%, particle size was <120 nm, and pdi was <0.2.

LNP Delivery In Vivo

Unless otherwise noted, CD-1 female mice, ranging from 6-10 weeks of age were used in each study. Animals were weighed and grouped according to body weight for preparing dosing solutions based on group average weight. LNPs were dosed via the lateral tail vein in a volume of 0.2 mL per animal (approximately 10 mL per kilogram body weight). The animals were observed at approximately 6 hours post dose for adverse effects. Body weight was measured at twenty-four hours post-administration, and animals were euthanized at various time points by exsanguination via cardiac puncture under isoflourane anesthesia. Blood was collected into serum separator tubes or into tubes containing buffered sodium citrate for plasma as described herein. For studies involving in vivo editing, liver tissue was collected from the median lobe or from three independent lobes (e.g., the right median, left median, and left lateral lobes) from each animal for DNA extraction and analysis.

Cohorts of mice were measured for liver editing by Next-Generation Sequencing (NGS) and serum TTR levels (data not shown).

Transthyretin (TTR) ELISA Analysis

Blood was collected and the serum was isolated as indicated. The total mouse TTR serum levels were determined using a Mouse Prealbumin (Transthyretin) ELISA Kit (Aviva Systems Biology, Cat. OKIA00111). Rat TTR serum levels were measured using a rat specific ELISA kit (Aviva Systems Biology catalog number OKIA00159) according to manufacture's protocol. Briefly, sera were serial diluted with kit sample diluent to a final dilution of 10,000-fold. This diluted sample was then added to the ELISA plates and the assay was then carried out according to directions.

NGS Sequencing

In brief, to quantitatively determine the efficiency of editing at the target location in the genome, genomic DNA was isolated and deep sequencing was utilized to identify the presence of insertions and deletions introduced by gene editing.

PCR primers were designed around the target site (e.g., TTR), and the genomic area of interest was amplified. Primer sequences are provided below. Additional PCR was performed according to the manufacturer's protocols (Illumina) to add the necessary chemistry for sequencing. The amplicons were sequenced on an Illumina MiSeq instrument. The reads were aligned to the human reference genome (e.g., hg38) after eliminating those having low quality scores. The resulting files containing the reads were mapped to the reference genome (BAM files), where reads that overlapped the target region of interest were selected and the number of wild type reads versus the number of reads which contain an insertion, substitution, or deletion was calculated.

The editing percentage (e.g., the "editing efficiency" or "percent editing") is defined as the total number of sequence reads with insertions or deletions over the total number of sequence reads, including wild type.

1. In Vivo Characterization of Cas9 mRNAs with Modified Nucleotides mRNAs comprising an ORF as set forth in SEQ ID NO: 5 were prepared with varying modified nucleotide content as shown in Table 5 below. The mRNAs were combined with a guide RNA (G282; SEQ ID NO: 42) targeting the transthyretin gene (TTR) and incorporated into LNPs. Unmodified cytidine was used in all LNPs except LNP420.

TABLE 5

| LNP417-LNP421 for in vivo studies | | |
|---|---|---|
| LNP | Cas9 SEQ ID NO | Modified nucleotides |
| LNP417 | 5 | N1-methyl-pseudouridine |
| LNP418 | 5 | None |
| LNP419 | 5 | Pseudouridine |
| LNP420 | 5 | Pseudouridine and 5-methyl cytidine |
| LNP421 | 5 | 60% N1-methyl-pseudouridine (40% unmodified uridine) |

LNP417-LNP421 were administered to mice at 0.5 mg/kg (mpk) or 1 mpk doses. Cytokine (IFN alpha, IL-6, TNF alpha, and MCP-1) induction was measured 4 hours post-dose (hpd). Results are shown in FIGS. 1A-D.

Figure 2A:
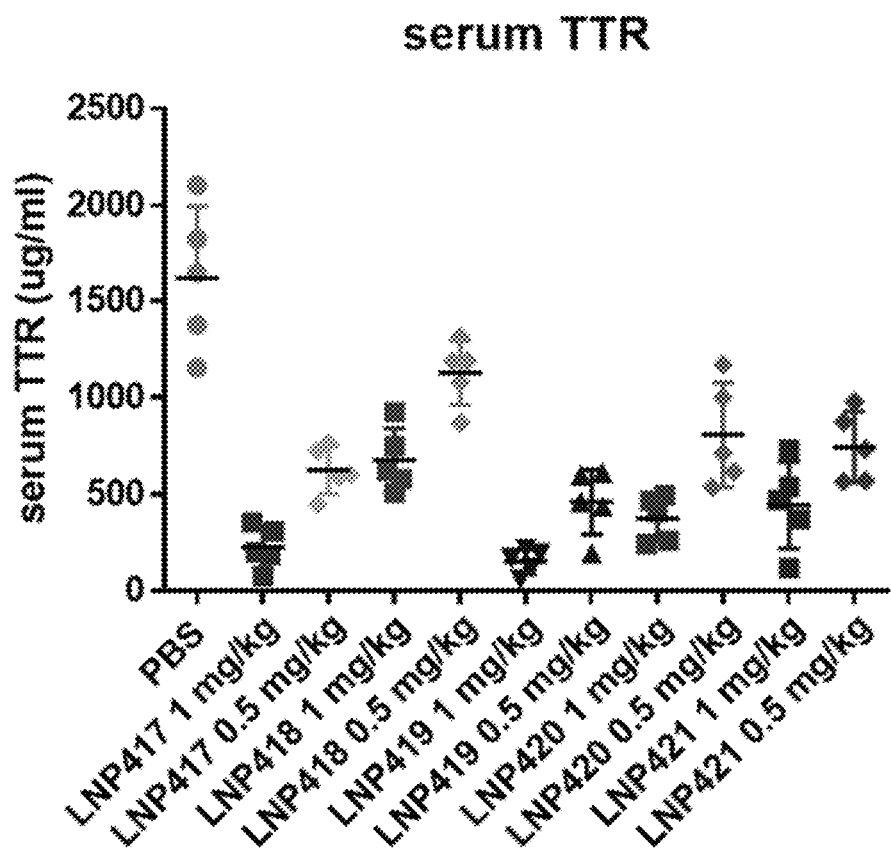
FIGS. 2A-2B show serum TTR levels and percentage liver editing following administration of PBS or LNP formulation LNP417-LNP421 at 0.5 or 1 mpk.
Figure 2B:
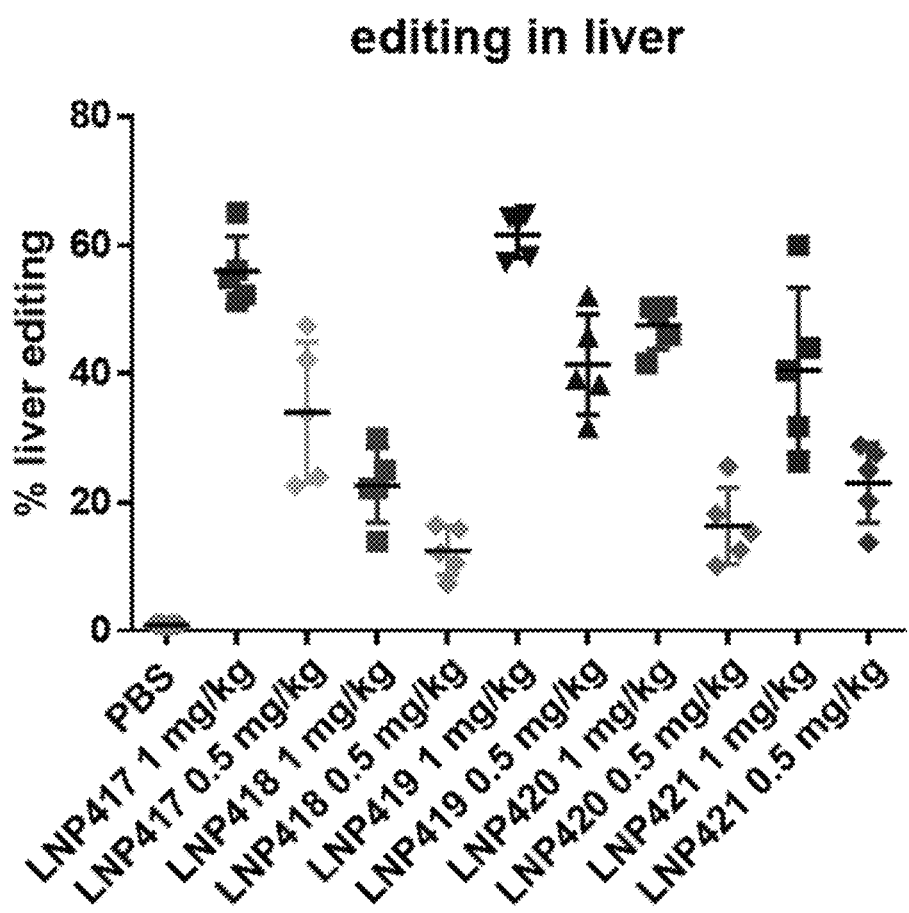

At necropsy at 7 days after dose, serum and liver were collected for serum TTR measurement and analysis of editing efficacy, respectively. Results are shown in FIGS. 2A-B.

It was observed that using pseudouridine and 5-methyl CTP almost completely abolished cytokine induction. Using N1-methyl pseudouridine at 60% (LNP421) or 100% (LNP417) also triggered less cytokine induction than the unmodified Cas9 mRNA, and the extent of reduction at 60% N1-methyl pseudouridine was similar to 100%.

All modified Cas9 constructs were similarly effective in reducing serum TTR and were more effective than the unmodified construct, perhaps due to increased stability. According to the liver editing data, the constructs using pseudouridine and N1-methyl pseudouridine were equally effective. The construct with pseudouridine and 5-methyl cytidine was significantly less effective than that with pseudouridine alone. The construct with 60% N1-methyl pseudouridine may have been slightly less effective than the construct with 100% N1-methyl pseudouridine.

2. Development and In Vitro Characterization of Modified mRNAs Encoding Cas9

A Cas9 sequence (SEQ ID NO: 1) was designed to improve liver expression and minimize uridines. Codons were chosen based on having the minimum possible uridine content and maximal expression of the corresponding tRNA in the liver. For liver tRNA expression, see Dittmar K A, *PLos Genetics* 2(12): e221 (2006). Reducing uridine content of the Cas9 mRNA was intended to decrease the innate immune response to the mRNA and/or provide other benefits. Table 6 shows the optimal liver codon based on tRNA levels and a codon with the minimum possible number of uridines. Instances where the minimal uridine codon differs from the optimal liver codon are in bold italics. Table also shows the number of each amino acid in the amino acid sequence of *S. pyogenes* Cas9 (SEQ ID NO: 3).

TABLE 6

Codon optimization parameters

| Amino Acid | | Optimal liver codon | Minimal uridine codon | Cas9 Frequency |
|---|---|---|---|---|
| A | Alanine | GCA | GCA | 73 |
| G | Glycine | GGA | GGA | 73 |
| V | Valine | GTC | GTC | 74 |
| D | Aspartic acid | GAT | *GAC* | 100 |
| E | Glutamic acid | GAA | GAA | 111 |
| I | Isoleucine | ATC | ATC | 93 |
| T | Threonine | ACA | ACA | 66 |
| N | Asparagine | AAC | AAC | 70 |
| K | Lysine | AAG | AAG | 155 |
| S | Serine | TCG | *AGC* | 79 |
| R | Arginine | AGA | AGA | 79 |
| L | Leucine | CTG | CTG | 148 |
| P | Proline | CCG | CCG | 36 |
| H | Histidine | CAC | CAC | 32 |
| Q | Glutamine | CAG | CAG | 52 |
| F | Phenylalanine | TTC | TTC | 64 |
| Y | Tyrosine | TAC | TAC | 55 |
| C | Cysteine | TGC | TGC | 2 |
| W | Tryptophan | TGG | TGG | 7 |
| M | Methionine | ATG | ATG | 22 |

In the case of aspartic acid and serine, the liver codon corresponding to the highest-expressed tRNA comprised a thymidine, which would be transcribed as a uridine in the corresponding mRNA. The minimal uridine codon was chosen for aspartic acid and serine (GAC and AGC, respectively). The Cas9 ORF sequence was 4140 nt long, contained 528 Us (12.8% uridine content), and avoided having any runs of 3 or more consecutive uridines in the ORF. There were 63 instances of UU dinucleotides in the sequence (126/4140=3% uridine dinucleotide content) SEQ ID NO: 2 provides an alternative Cas9 sequence that contains 19.6% uridine as an RNA ORF.

SEQ ID NO: 3 provides the amino acid sequence of Cas9, which is encoded by both SEQ ID Nos: 1 and 2, as the new design of the Cas9 ORF did not alter the encoded amino acid sequence. SEQ ID NO: 4 is the RNA version of the ORF of SEQ ID NO: 1. SEQ ID NO: 5 is the RNA version of the ORF of SEQ ID NO: 2.

The effects of modified nucleotides were also evaluated. Modified UTPs used to transcribe Cas9 transcription included N1-methyl-pseudo-UTP and 5-methoxy-UTP.

The structure of N1-methyl-pseudo-UTP is:

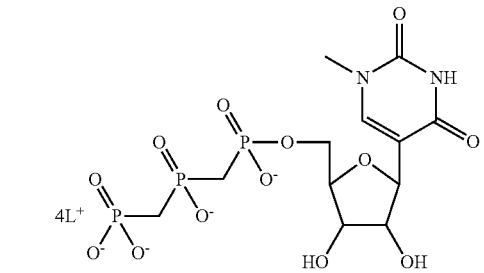

The structure of 5-methoxy-UTP is:

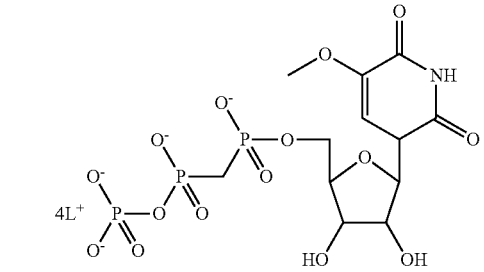

Figure 3:
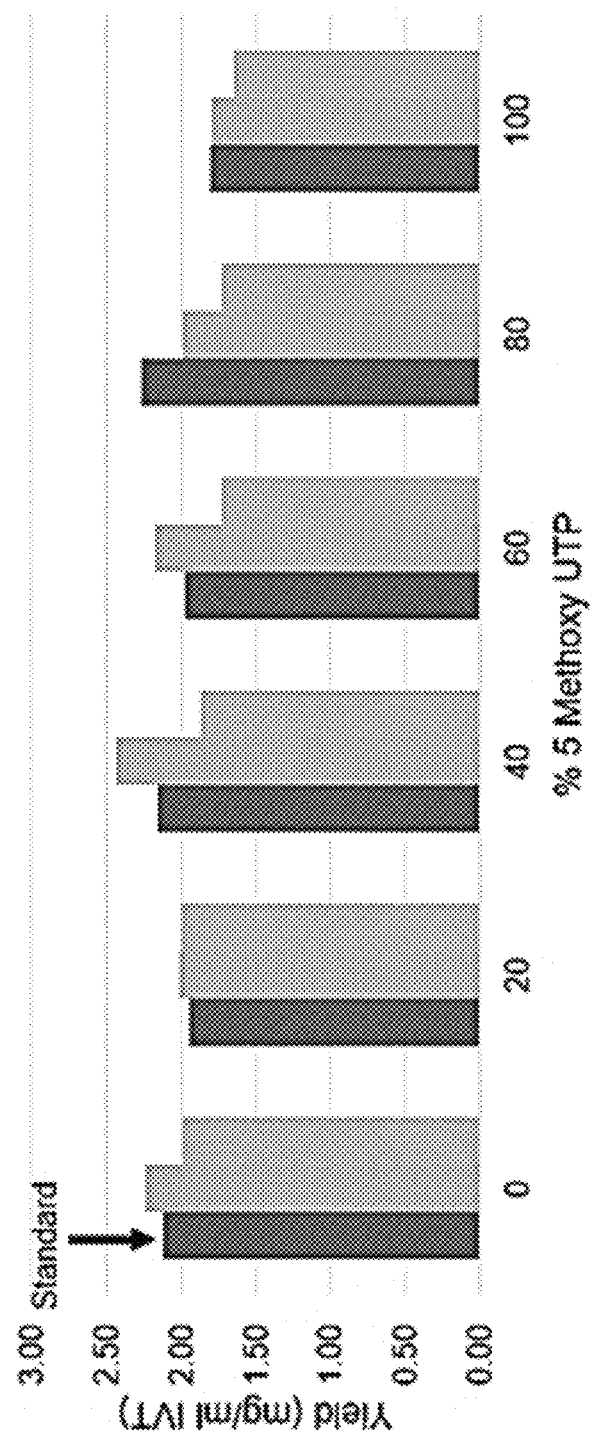
FIG. 3 shows in vitro transcription (IVT) yields for transcription from Cas9 DNA constructs. Transcription was performed with either unmodified uridine-5'-triphosphate (UTP) or with N1-methyl-pseudo-UTP alone (0 on the horizontal axis), mixed with an indicated proportion of 5-methoxy UTP (20-80 on the horizontal axis), or with 100% 5-methoxy UTP (100). For each set of three bars, the left bar used N1-methyl-pseudo-UTP and/or 5-methoxy UTP and SEQ ID NO: 2; the center bar used unmodified UTP and/or 5-methoxy UTP and SEQ ID NO: 2; and the right bar used unmodified UTP and/or 5-methoxy UTP and SEQ ID NO: 1.

In vitro transcription (IVT) yields were determined for mRNAs comprising ORFs of SEQ ID NO: 4 and 5. Both encoded a nuclear localization signal (NLS). The sequence comprising SEQ ID NO: 5 was transcribed in the presence of either unmodified UTP or N1-methyl-pseudo-UTP. The sequence comprising SEQ ID NO: 4 was transcribed in the presence of unmodified UTP. IVT was also performed with increasing percentages of 5-methoxy-UTP, as shown on the X-axis of FIG. 3, which shows yields for each of these constructs, determined spectrophotometrically.

These results show that there was a slight decrease in yield as the 5-methoxyuridine content of the mRNA increased, but mRNA yield was acceptable under all conditions. Thus, Cas9 mRNA could be generated for both Cas9 sequences with acceptable yields across the conditions tested.

Figure 4:
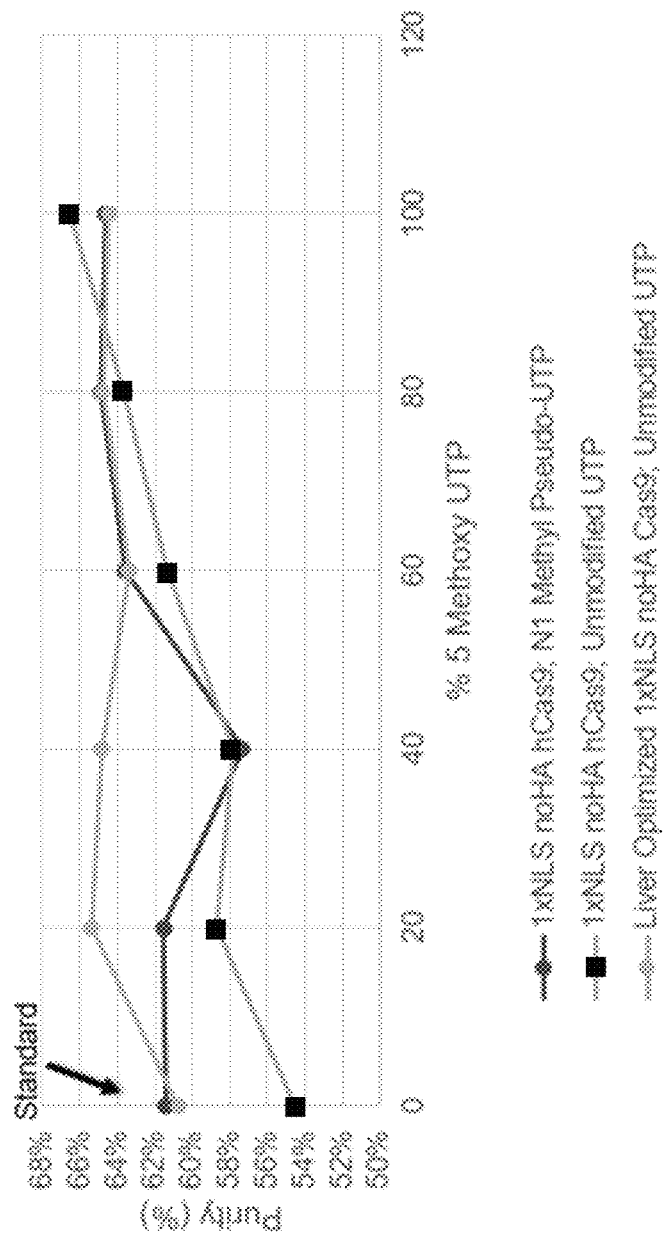
FIG. 4 shows purity of mRNA from in vitro transcription (IVT) results for Cas9 (SEQ ID NO: 2) and optimized Cas9 (SEQ ID NO: 1) DNA constructs. Transcription was performed from the Cas9 sequence of SEQ ID NO: 2 with unmodified uridine-5'-triphosphate (UTP) (squares) or with N1-methyl-pseudo-UTP (dark circles) alone (0) or mixed with an indicated proportion of 5-methoxy UTP (20-80), or with 100% 5-methoxy UTP (100). Transcription was performed from the Cas9 sequence of SEQ ID NO: 1 (light circles) with unmodified UTP (0) or mixed with an indicated proportion of 5-methoxy UTP (20-80), or with 100% 5-methoxy UTP (100). Each coding sequence included a nuclear localization signal.

The purity of the in vitro-transcribed mRNAs was calculated using area under the curve (AUC) analysis on mRNA capillary electrophoresis (CE) traces obtained using an Agilent Bioanalyzer 2100 (FIG. 4). The SEQ ID NO: 5 Cas9 mRNA generated with unmodified UTP generally increased in purity with increasing 5-methoxy-UTP substitution while the same construct made with N1-methyl-pseudo-UTP was less affected by increasing 5-methoxy-UTP substitution.

The SEQ ID NO: 4 Cas9 made with unmodified UTP seemed relatively unaffected by 5-methoxy-UTP substitution, with a slight increase in purity coming between 0 and 20% substitution with 5-methoxy-UTP.

Figure 5B:
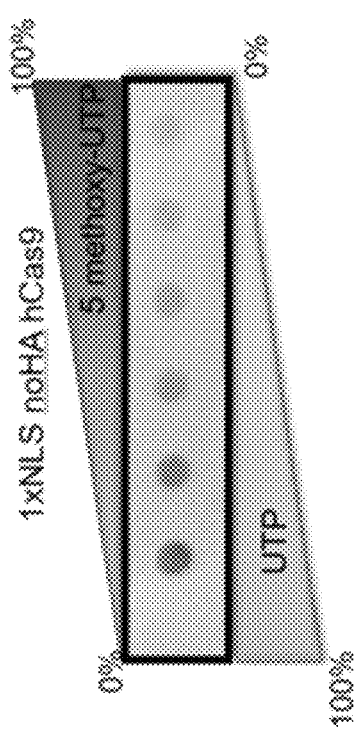
FIGS. 5A-5D show anti-dsRNA antibody dot blot results. Results are with double-stranded RNA control (A), Cas9 transcribed in presence of UTP and/or 5-methoxy UTP (B), Cas9 mRNA sequence comprising SEQ ID NO: 4 transcribed in presence of UTP and/or 5-methoxy UTP (C), and Cas9 transcribed in presence of N1-methyl-pseudo-UTP and/or 5-methoxy UTP (D). Panels (B)-(D) were performed with transcripts containing 0% to 100% 5-methoxy UTP and 100% to 0% UTP or N1-methyl UTP.
Figure 5D:
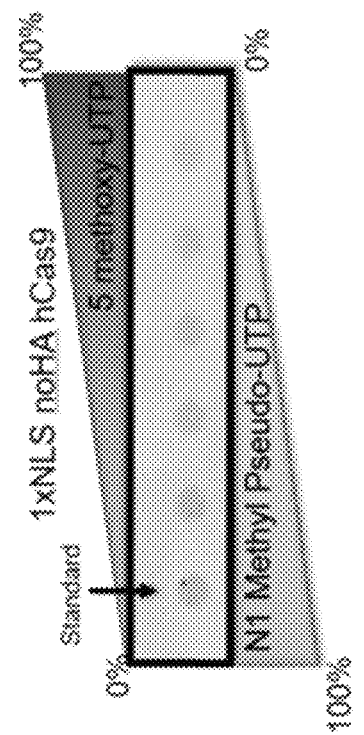
Figure 5A:
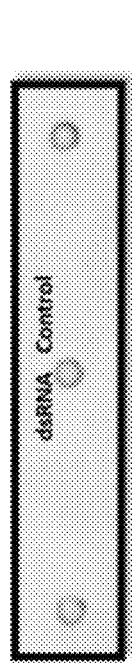
Figure 5C:
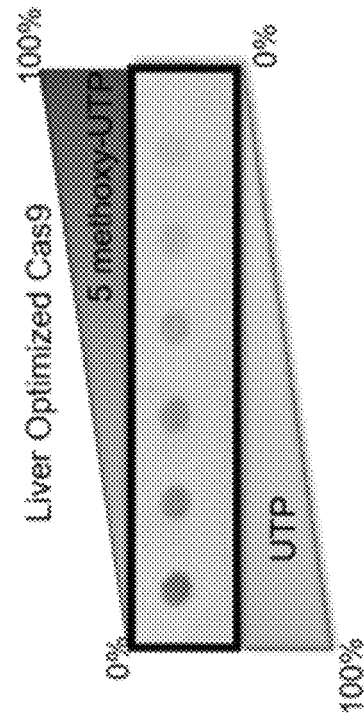

The immunogenicity of different mRNAs was assessed by dot-blot analysis with an anti-dsRNA antibody as a measure of double-stranded (ds) mRNA character, an indicator of potential immunogenicity (FIGS. 5A-D). FIGS. 5B and 5D used the Cas9 mRNA sequence comprising SEQ ID NO: 5 and FIG. 5C used the Cas9 mRNA sequence comprising SEQ ID NO: 4. For constructs generated with unmodified UTP (FIGS. 5B-C), there was a general decrease in apparent double-strandedness with increasing 5-methoxy-UTP content. The mRNA generated with N1-methyl-pseudo-UTP (FIG. 5D) showed less binding to the anti-dsRNA antibody but binding to the antibody also appeared to decrease with increasing 5-methoxy-UTP content.

Editing efficiency was next assessed in vitro by transfecting mRNA together with a guide (G209; SEQ ID NO: 64) targeting transthyretin (TTR) into Neuro 2A cells and measuring percentage editing.

Figure 6A:
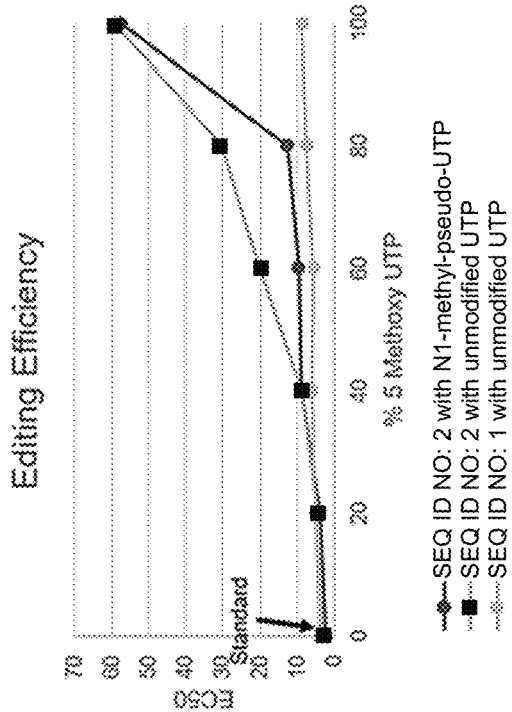
FIGS. 6A and 6B show in vitro editing efficiency of mRNAs in Neuro 2A cells treated with Cas9 mRNA, presented as percentage editing (A) or editing EC50 (B). The effect of increasing concentrations of 5-methoxy-UTP in the Cas9 mRNA was assessed. Transcription was performed from the Cas9 sequence of SEQ ID NO: 2 with N1-methyl-pseudo-UTP (left series in A; dark circles in B) or with unmodified uridine-5'-triphosphate (UTP) (center series in A; squares in B) alone (0) or mixed with an indicated proportion of 5-methoxy UTP (20-80), or with 100% 5-methoxy UTP (100). Transcription was performed from the Cas9 sequence of SEQ ID NO: 1 (right series in A; light circles in B) with unmodified UTP (0) or mixed with an indicated proportion of 5-methoxy UTP (20-80), or with 100% 5-methoxy UTP (100). Each coding sequence included a nuclear localization signal.
Figure 6B:
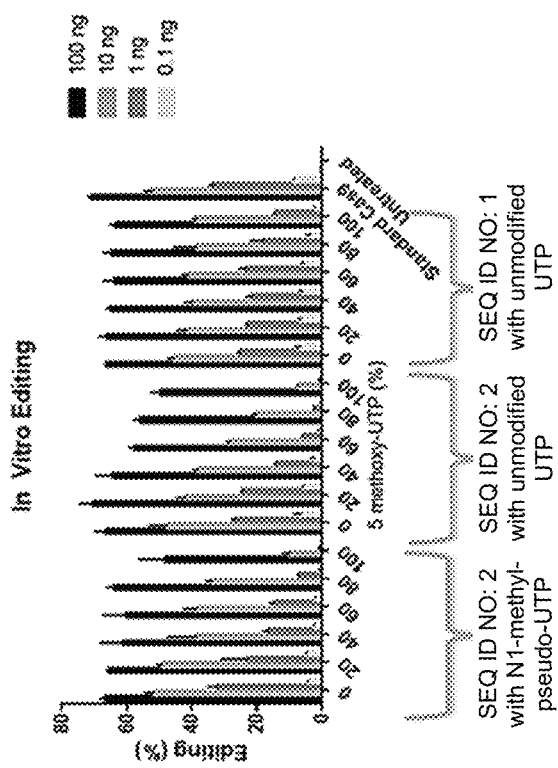
Figure 7A:
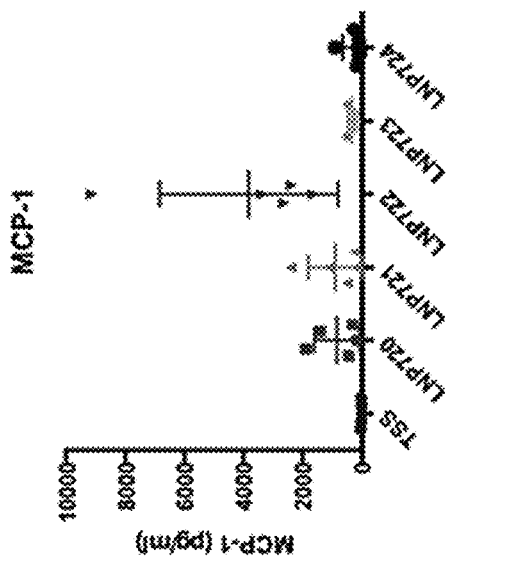
FIGS. 7A-7D present serum cytokine levels at 4 hours post-dose for LNP formulations LNP720-LNP724. The asterisk in FIG. 7A indicates that at least one individual measurement was below the limit of detection.
Figure 7B:
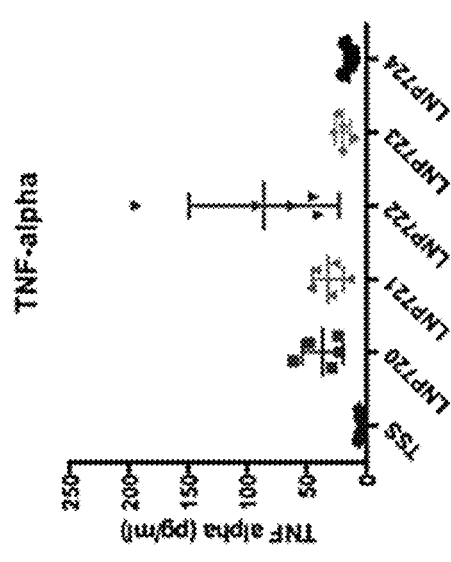
Figure 7C:
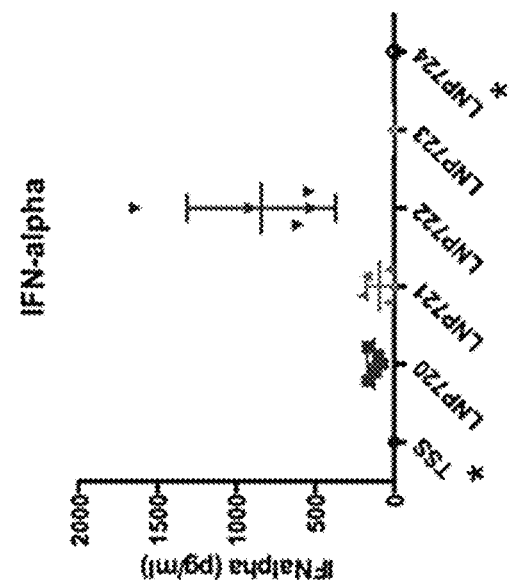
Figure 7D:
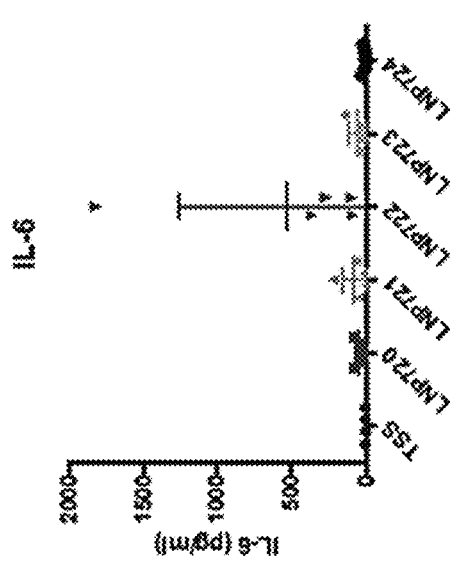

As shown in FIG. 6A, Cas9 mRNA transcribed from a construct comprising SEQ ID NO: 2 with N1-methyl-pseudo-UTP with 2 nuclear localization sequences and an HA tag (group indicated by left-most brace), Cas9 mRNA transcribed from a construct comprising SEQ ID NO: 2 transcribed with UTP with 2 nuclear localization sequences and an HA tag (group indicated by middle brace), and Cas9 mRNA transcribed from a construct comprising SEQ ID NO: 1 with UTP (group indicted by right-most brace) were assessed. For each group, different concentrations of mRNA from 0.1 ng-100 ng were assessed with transcription in increasing amounts of 5-methoxy-UTP from 0% to 100% as indicated on the X-axis. Untreated cells did not show measurable editing. FIG. 6B shows editing efficiency data expressed as EC50 values (ng).

Increasing 5-methoxy-UTP content during transcription appeared to have a negative effect on editing efficiency in both SEQ ID NO: 5 conditions, with transcripts also containing N1-methyl-pseudc-UTP being more robust than UTP-containing transcripts (e.g., at 60% and 80% 5-methoxy-UTP). In contrast, the editing efficiency with Cas9 mRNA sequence comprising SEQ ID NO: 4 showed little if any effect from increasing 5-methoxy-UTP content. Thus, according to this system, the Cas9 mRNA sequence comprising SEQ ID NO: 4 mRNA can provide similar editing efficiency with up to 100% 5-methoxy-uridine as the versions containing unmodified uridine.

3. In Vivo Characterization of mRNAs Encoding Cas9

The in vivo efficacy of Cas9 mRNA sequence comprising SEQ ID NO: 4 versus Cas9 mRNA sequence comprising SEQ ID NO: 5 and the effect of transcription of the Cas9 mRNA sequence comprising SEQ ID NO: 4 in the presence of unmodified UTP, N1-methyl-pseudo-UTP, 40% 5-methoxy-UTP+60% unmodified UTP, or 100% 5-methoxy-UTP were evaluated. Table 7 provides information on these in vivo study groups. Each mRNA was administered as a lipid nanoparticle (LNP) formulation.

TABLE 7

LNP720-LNP724 for in vivo studies

| LNP | Cas9 ORF SEQ ID NO | Modified nucleotide |
| --- | --- | --- |
| LNP720 | 5 | N1-methyl-pseudouridine |
| LNP721 | 4 | N1-methyl-pseudouridine |
| LNP722 | 4 | Unmodified |
| LNP723 | 4 | 40% 5-methoxyuridine/60% unmodified |
| LNP724 | 4 | 5-methoxyuridine |

The in vivo study design was as follows. CD-1 female mice were from Charles River (n=5 per group). Animals were dosed intravenously (i.v.) at 1 mg per kilogram (mpk) or 0.5 mpk along with a single guide RNA directed against transthyretin (TTR) (SEQ ID No: 42). Animals receiving 1 mpk dose were bled at 4 hours post-dose (hpd) for cytokine analysis of MCP-1, IL-6, IFN-alpha, and TNF-alpha. Animals were assessed at 24 hpd for overall wellness. Necropsy was performed at 7 days post-dose, with blood collected for serum TTR analysis and liver collected for next generation sequencing (NGS) editing analysis.

Serum from animals dose with 1 mpk was collected and 4 hpd, and serum was prepared and run on ProcartaPlex) Mouse 4-plex assay (Thermo Fisher) following manufacturer's instructions. Results for serum levels of MCP-1, IL-6, IFN-alpha, and TNF-alpha are presented in FIGS. 7A-D. These results indicated that the Cas9 mRNA sequence comprising SEQ ID NO: 4 prepared with a modified UTP (LNP721, LNP723, or LNP724) showed relatively low levels of cytokine production.

Figure 8B:
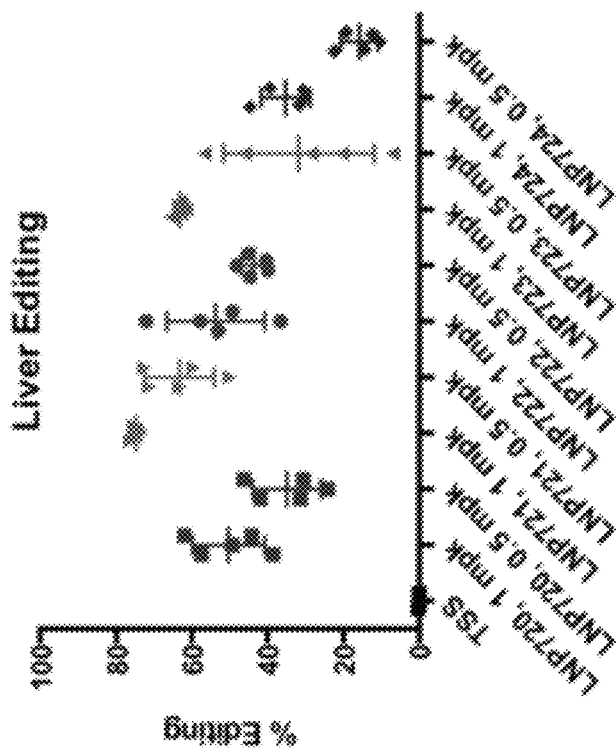
FIGS. 8A and 8B present serum TTR levels (A) and percentage of TTR editing in liver (B) at 7 days post-dosing with LNP formulations LNP720-LNP724. The asterisk in FIG. 8A indicates that at least one individual measurement was below the limit of detection.
Figure 8A:
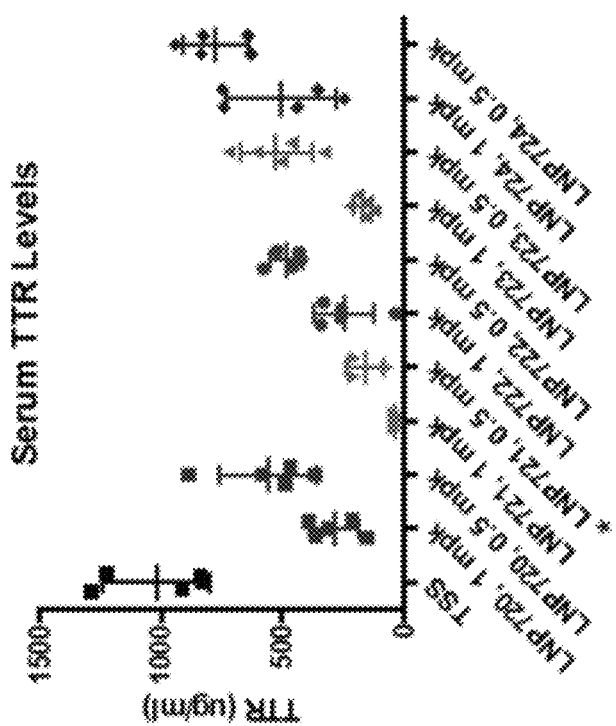

Levels of TTR in the serum were also assessed at 7 days post-dose, as shown in FIG. 8A and Table 8 The TSS (i.e, 5% sucrose, 45 mM NaCl, 50 mM Tris at pH 7.5) sample indicates levels of TTR without LNP treatment. All LNP formulations are described in Table 7.

TABLE 8

Results of serum TTR levels after dosing of LNP720-LNP724

| LNP | Cas9 ORF SEQ ID NO | Modified nucleotide | TTR (ug/ml), 0.5 mpk | TTR (ug/ml), 1 mpk |
| --- | --- | --- | --- | --- |
| TSS | N/A | N/A | 1019.0 | |
| LNP720 | 5 | N1-methyl-pseudouridine | 559.4 | 287.2 |
| LNP721 | 4 | N1-methyl-pseudouridine | 160.1 | 35.3 |
| LNP722 | 4 | Unmodified | 483.4 | 247.0 |
| LNP723 | 4 | 40% 5-methoxyuridine/ 60% unmodified | 525.8 | 170.1 |
| LNP724 | 4 | 5-methoxyuridine | 774.0 | 505.4 |

Table 9 and FIG. 8B provide results in terms of percent editing of TTR in the liver as measured by next-generation sequencing (NGS).

TABLE 9

Results as percent editing of TTR in liver after dosing of LNP720-LNP724

| LNP | Cas9 SEQ ID NO | Modified nucleotide | % Editing, 0.5 mpk | % Editing, 1 mpk |
| --- | --- | --- | --- | --- |
| TSS | N/A | N/A | 0.16 | |
| LNP720 | 5 | N1-methyl-pseudouridine | 34.9 | 50.3 |
| LNP721 | 4 | N1-methyl-pseudouridine | 63.3 | 74.8 |
| LNP722 | 4 | Unmodified | 43.6 | 53.7 |
| LNP723 | 4 | 40% 5-methoxyuridine/ 60% unmodified | 31.8 | 63.2 |
| LNP724 | 4 | 5-methoxyuridine | 15.9 | 35.2 |

Compared to the TSS control sample, all LNPs comprising Cas9 showed reduction in serum TTR levels and above-baseline editing. In comparing standard Cas9 mRNA (SEQ ID No: 5, LNP720) to Cas9 mRNA sequence comprising SEQ ID NO: 4 mRNA (SEQ ID No: 4, LNP721) both transcribed with N1-methyl-pseudo-UTP, the Cas9 mRNA sequence comprising SEQ ID NO: 4 showed improved activity (lower TTR and higher % editing). For the Cas9 m.RNA sequence comprising SEQ ID NO: 4, activity was highest with N1-methyl-pseudo-UTP, and transcription with 40% 5-methoxy-UTP+60% unmodified UTP (LNP723) gave greater activity than with 100% 5-methoxy-UTP (LNP724).

As a measure of off-target effects, editing in the spleen was also measured for animals dosed with 1 mpk of the LNP formulations described above, as shown in FIG. 7 and Table 10. For all LNP formulations, whether with Cas9 or optimized Cas9, greater than 20-fold higher editing was seen in the liver (FIG. 6A).

TABLE 10

Results on percent editing of TTR in spleen after 1 mpk dosing of LNPs comprising sgRNA and various Cas9

| LNP | Cas9 SEQ ID NO | Modified nucleotide | % Editing, 1 mpk |
|---|---|---|---|
| TSS | N/A | N/A | 0.1 |
| LNP720 | 5 | N1-methyl-pseudouridine | 0.66 |
| LNP721 | 4 | N1-methyl-pseudouridine | 2.42 |
| LNP722 | 4 | Unmodified | 0.68 |
| LNP723 | 4 | 40% 5-methoxyuridine/60% unmodified | 1.12 |
| LNP724 | 4 | 5-methoxyuridine | 0.34 |

4. Characterization of Efficacy of mRNAs Encoding Cas9 in Primary Mouse Hepatocytes The efficacy of various LNPs was evaluated in vitro in primary mouse hepatocytes (PMHs).

Figure 10:
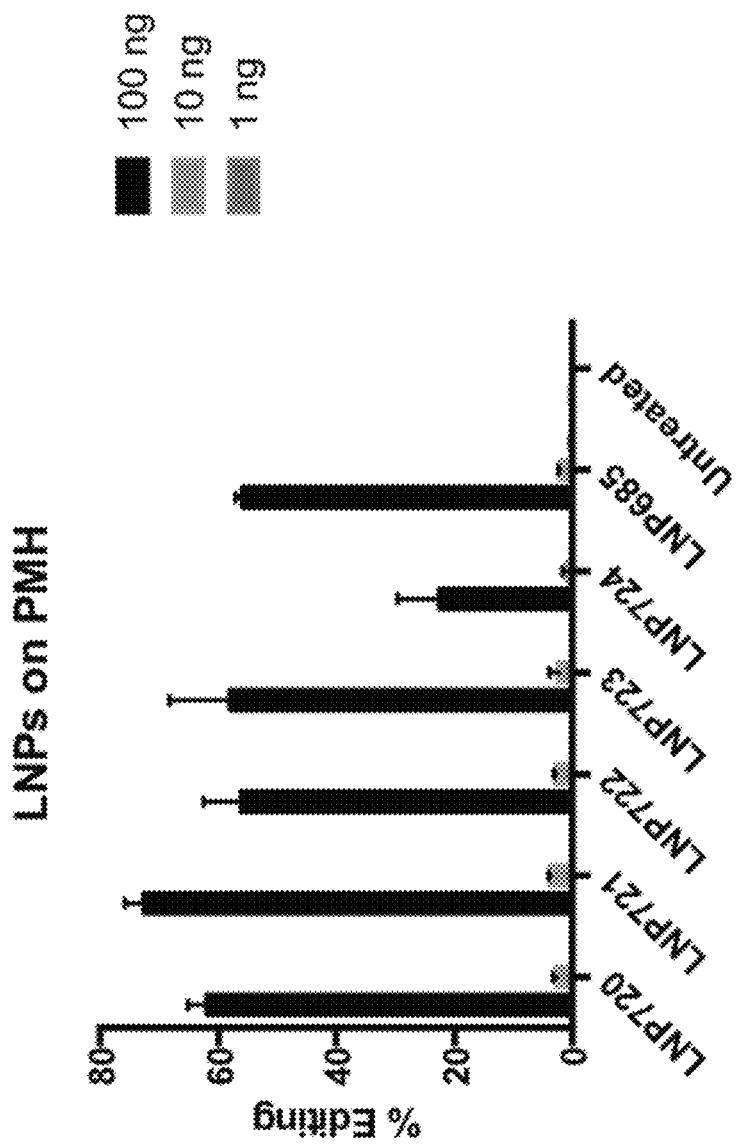
FIG. 10 shows percentage of editing of TTR in primary mouse hepatocytes (PMH) with LNP formulations LNP720-LNP724 and LNP685.

At 100 ng, all LNPs described in Table 5 supported editing of TTR, as shown in FIG. 10. As expected, untreated cells did not show measurable editing of TTR.

Table 11 shows EC50 values calculated for each LNP based on the data presented in FIG. 10.

TABLE 11

Estimated EC50 values (ng) for gene editing of TTR in PMHs

| LNP | EC50 |
|---|---|
| LNP720 | 45.65 |
| LNP721 | 23.04 |
| LNP722 | 54.00 |
| LNP723 | 52.40 |
| LNP724 | 164.1 |
| LNP685 | 59.88 |

5. In Vivo Characterization of Cas9 mRNA-Containing LNPs in Rats

The in vivo efficacy of Cas9 mRNA sequence comprising SEQ ID NO: 4 versus Cas9 mRNA sequence comprising SEQ ID NO: 5 were evaluated in rats. Table 12 provides information on these in vivo study groups. Standard Cas9 mRNA refers to SEQ ID No: 5, while U-depleted (U-dep) mRNA refers to SEQ ID No: 4. Each mRNA was administered as a lipid nanoparticle (LNP) formulation.

Details of LNP716 (Standard Cas9) and LNP738 (U-depleted) LNP formulations are shown in Table 12.

TABLE 12

LNP formulation characterization

| LNP ID | RNA prep and process | N:P | RNA Concentration (mg/mL) | Encapsulation (%) | Particle Size (nm) | Particle PDI |
|---|---|---|---|---|---|---|
| 716 | Citrate-NaCl; X-flow_TFF | 4.5 | 2.00 | 98 | 88.42 | 0.056 |
| 738 | Citrate-NaCl; X-flow_TFF | 4.5 | 2.22 | 97 | 92.80 | 0.044 |

PDI = polydispersity index
N:P = N:P ratio, as described above

Serum TTR was measured as described previously.

Figure 9:
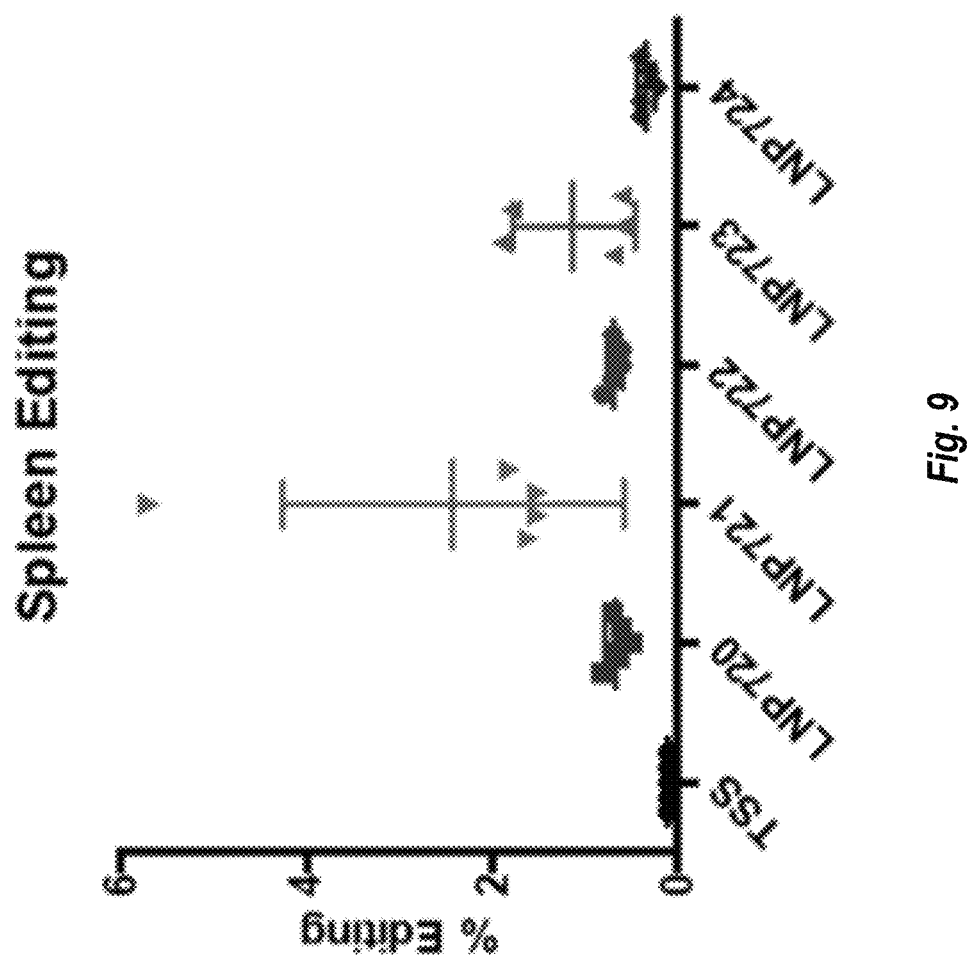
FIG. 9 shows percentage of editing of TTR in the spleen at 7 days post-dosing with LNP formulations LNP720-LNP724 at 1 mpk.
Figures 11A, 11B:
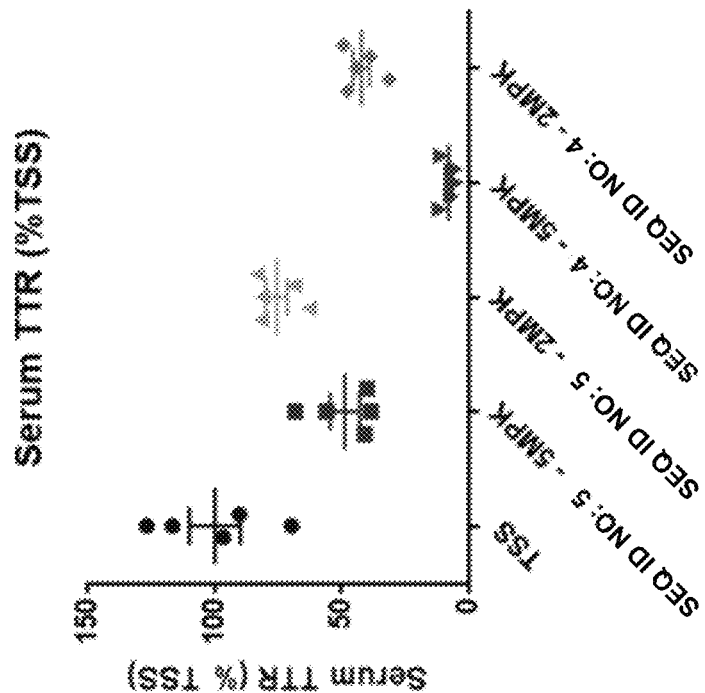
FIGS. 11A and 11B show serum TTR levels following dosing of formulations comprising Cas9 mRNAs in which the ORFs had sequences of SEQ ID NO: 5 or 4. The TTR data are presented as serum levels (A) or percent relative to TTR levels in TSS-treated animals (B).
Figure 12:
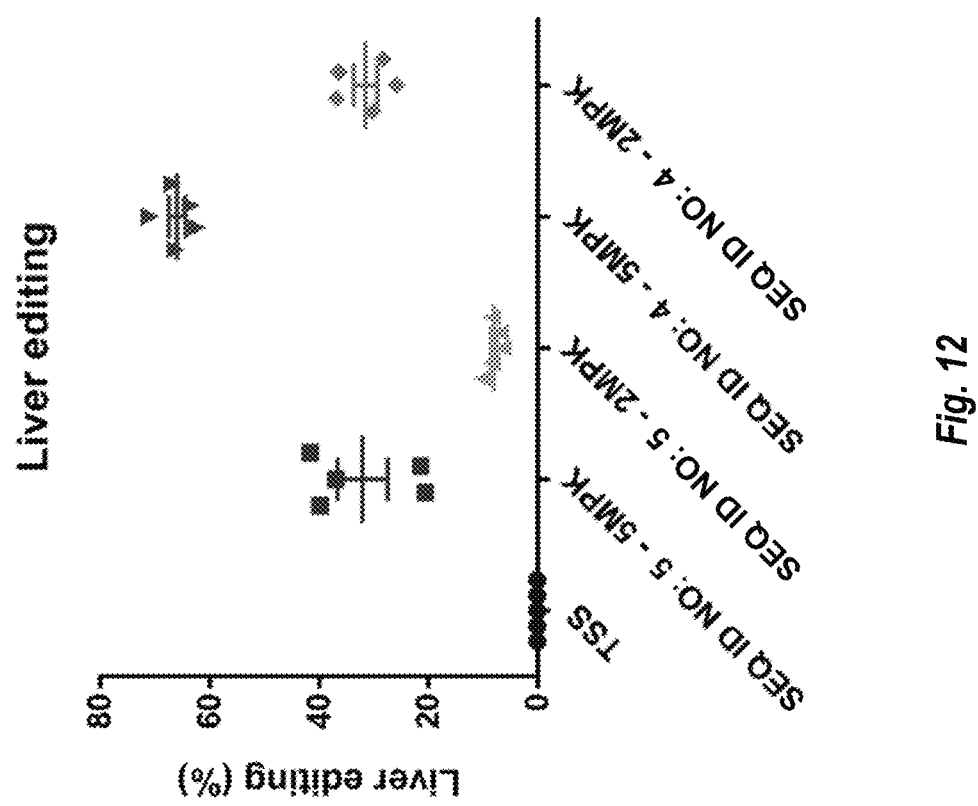
FIG. 12 shows the percentage of TTR editing in liver following dosing of formulations comprising a Cas9 mRNA in which the ORF had the sequence of SEQ ID NO: 5 or 4 at 5 mpk or 2 mpk.

Cas9 mRNA having an ORF of SEQ ID NO: 5 was compared to Cas9 mRNA having an ORF of SEQ ID NO: 4 (FIGS. 11A-B) in rats at doses of 2 mpk and 5 mpk, as shown in FIG. 9A and Table 13. These data indicate that the Cas9 ORF of SEQ ID NO: 4 induced greater reduction in serum TTR compared to the Cas9 ORF of SEQ ID NO: 5 at both 2 mpk and 5 mpk. FIG. 9B and Table 13 present these results as percentages relative to the value for the TSS-treated control. The 5 mpk dose of U-dep Cas9 LNP induced a reduction of greater than 90% in serum TTR levels.

TABLE 13

Serum TTR levels following dosing with LNP716 and LNP738 Cas9 formulations

| LNP | Cas9 | Dose (MPK) | Serum TTR (ug/mL) | Serum TTR (% KD) |
|---|---|---|---|---|
| TSS | — | — | 1954.40 | — |
| 716 | Standard | 5 | 950.36 | 51.37 |
|  |  | 2 | 1474.58 | 24.55 |
| 738 | U-Dep | 5 | 153.30 | 92.16 |
|  |  | 2 | 824.93 | 57.79 |

% KD = % knockdown compared to average serum concentration of TSS samples.

FIG. 10 and Table 14 show liver editing of TTR following dosing with the LNP716 (standard) and LNP738 (U-dep) formulations at 2 mpk and 5 mpk. While TSS showed negligible editing, both the LNP716 and LNP738 formulations induced liver editing of TTR. In comparing the formulations, the LNP738 formulation comprising U-depletion induced more than twice the editing of the LNP716 formulation comprising standard Cas9.

TABLE 14

Liver editing of TTR following dosing with U-depleted and standard Cas9 formulations

| LNP | Cas9 | Dose (MPK) | Liver editing (%) |
|---|---|---|---|
| TSS | — | — | 0.10 |
| 716 | Standard | 5 | 32.14 |
|  |  | 2 | 8.04 |
| 738 | U-Dep | 5 | 66.02 |
|  |  | 2 | 31.60 |

These data indicate the U-depleted Cas9 mRNA markedly improved the extent of editing of TTR in the liver.

6. Characterization of mRNAs with Various UTRs mRNAs encoding Cas9 with UTRs and +/−a hemagglutinin (HA) tag as indicated in Table 15 were formulated as LNPs with a guide RNA targeting TTR (G282; SEQ ID NO: 42)). The LNPs were assembled using a Nano Assemblr™, contained 45% Lipid A, 9% DSPC, 44% cholesterol, and 2% PEG2k-DMG, were purified using Amicon PD10 filters, and used at a concentration of 0.5 mg/ml (LNP concentration). CD-1 female mice (n=5 per group) were dosed i.v. at 0.5 or 1.0 mpk. At 7 days post-dose, animals were sacrificed, blood and the liver were collected, and serum TTR and liver editing were measured.

TABLE 15

LNP662-LNP669 mRNA descriptions and results of serum TTR and liver editing analyses

| LNP | mRNA Description | Dose (mpk) | Serum TTR (Avg ug/mL) | Serum TTR (Avg % KD) | Liver editing (%) |
|---|---|---|---|---|---|
| TSS | — | — | 944.52 | | 0.06 |
| LNP662 | ORF: SEQ ID NO: 5; noHA Tag | 1 | 729.56 | 22.76 | 20.08 |
| | | 0.5 | 988.75 | −4.68 | 8.26 |
| LNP663 | ORF: SEQ ID NO: 45 with HA Tag | 1 | 488.62 | 48.27 | 39.12 |
| | | 0.5 | 842.88 | 10.76 | 20.18 |
| LNP664 | ORF: SEQ ID NO: 45 with HA Tag; HBA UTRs | 1 | 628.35 | 33.47 | 32.68 |
| | | 0.5 | 1087.10 | −15.10 | 14.68 |
| LNP665 | ORF: SEQ ID NO: 45 with HA Tag; HBB UTRs | 1 | 524.43 | 44.48 | 42.70 |
| | | 0.5 | 797.37 | 15.58 | 18.72 |
| LNP666 | ORF: SEQ ID NO: 45 with HA Tag; XBG UTRs | 1 | 233.46 | 75.28 | 54.28 |
| | | 0.5 | 1011.22 | −7.06 | 17.96 |
| LNP667 | ORF: SEQ ID NO: 4; no HA tag | 1 | 197.58 | 79.08 | 58.64 |
| | | 0.5 | 689.24 | 27.03 | 31.26 |
| LNP668 | ORF: SEQ ID NO: 4; no HA tag; unmodified NTPs | 1 | 622.42 | 34.10 | 34.44 |
| | | 0.5 | 811.94 | 14.04 | 21.30 |
| LNP669 | ORF: SEQ ID NO: 5; no HA Tag; unmodified NTPs | 1 | 1050.68 | −11.24 | 9.82 |
| | | 0.5 | 1189.70 | −25.96 | 4.04 |

UTRs in the mRNAs were HSD/Alb unless otherwise indicated. HBA: human alpha globin; HBB: human beta globin (HBB); XBG: xenopus beta globin (XBG). mRNAs contained 100% N1-methyl pseudouridine in place of uridine unless otherwise indicated.

Figure 13A:
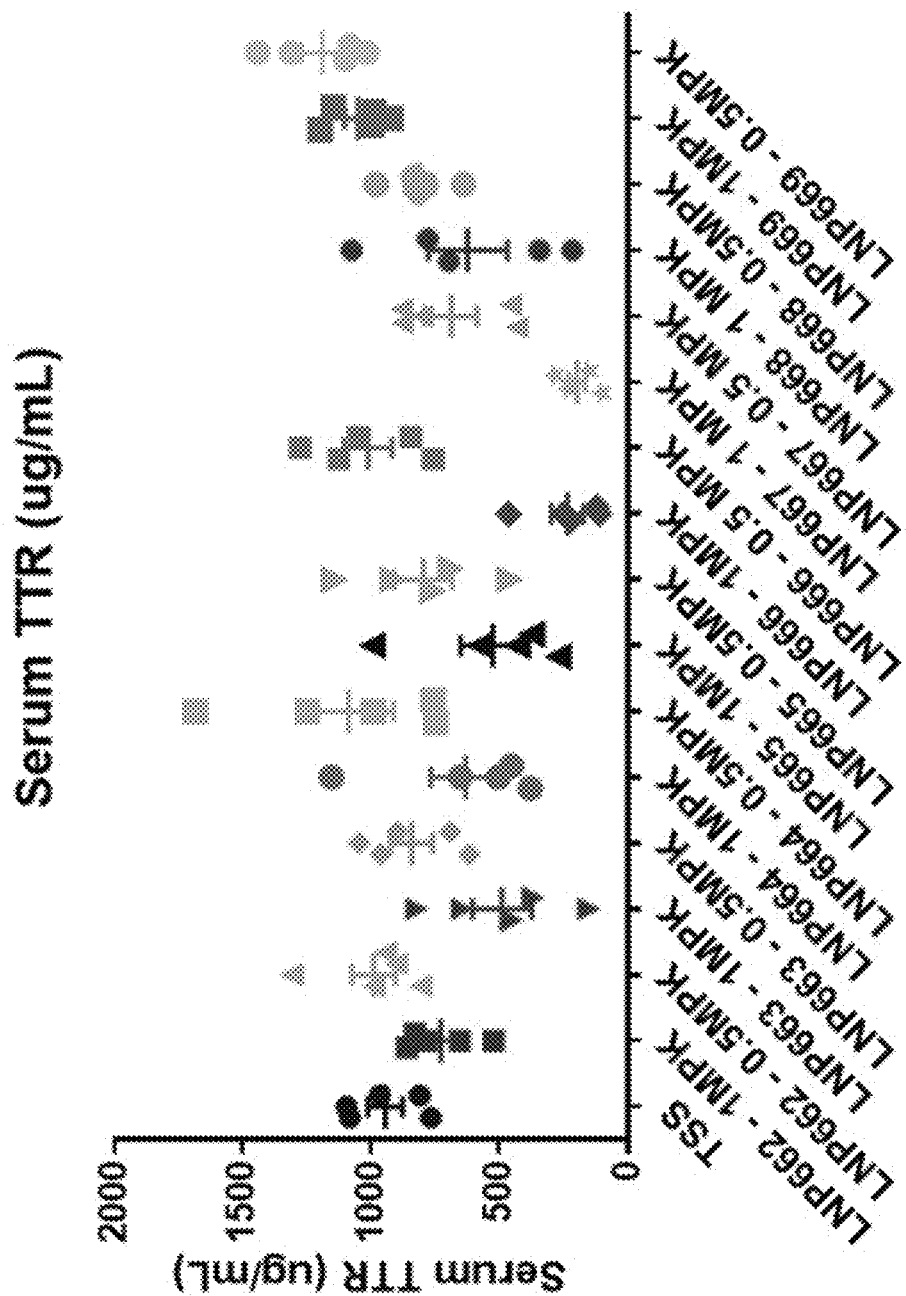
FIGS. 13A-E show serum TTR levels and percentage of TTR editing in liver following dosing of the indicated LNP formulations.
Figure 13B:
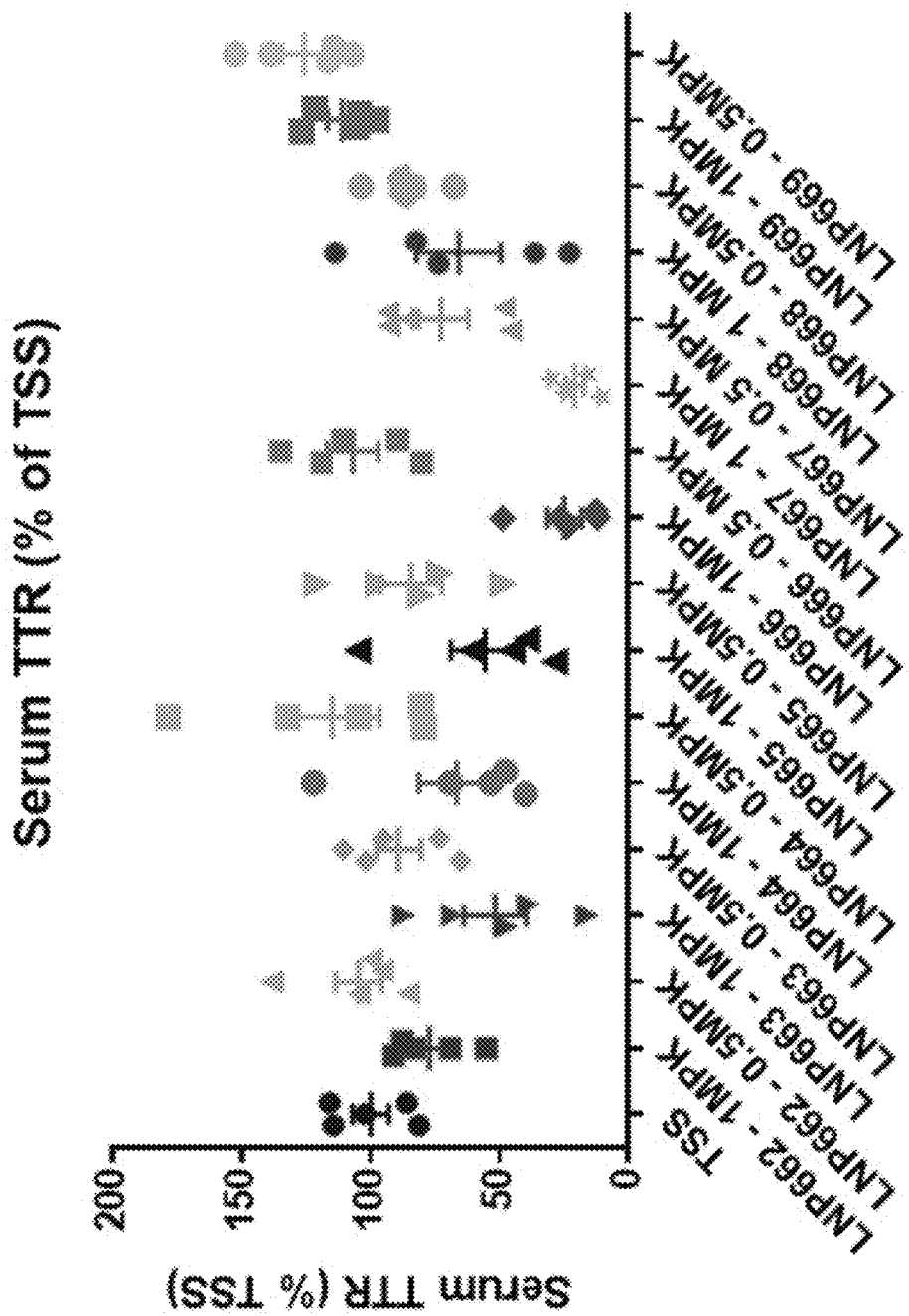
Figure 13C:
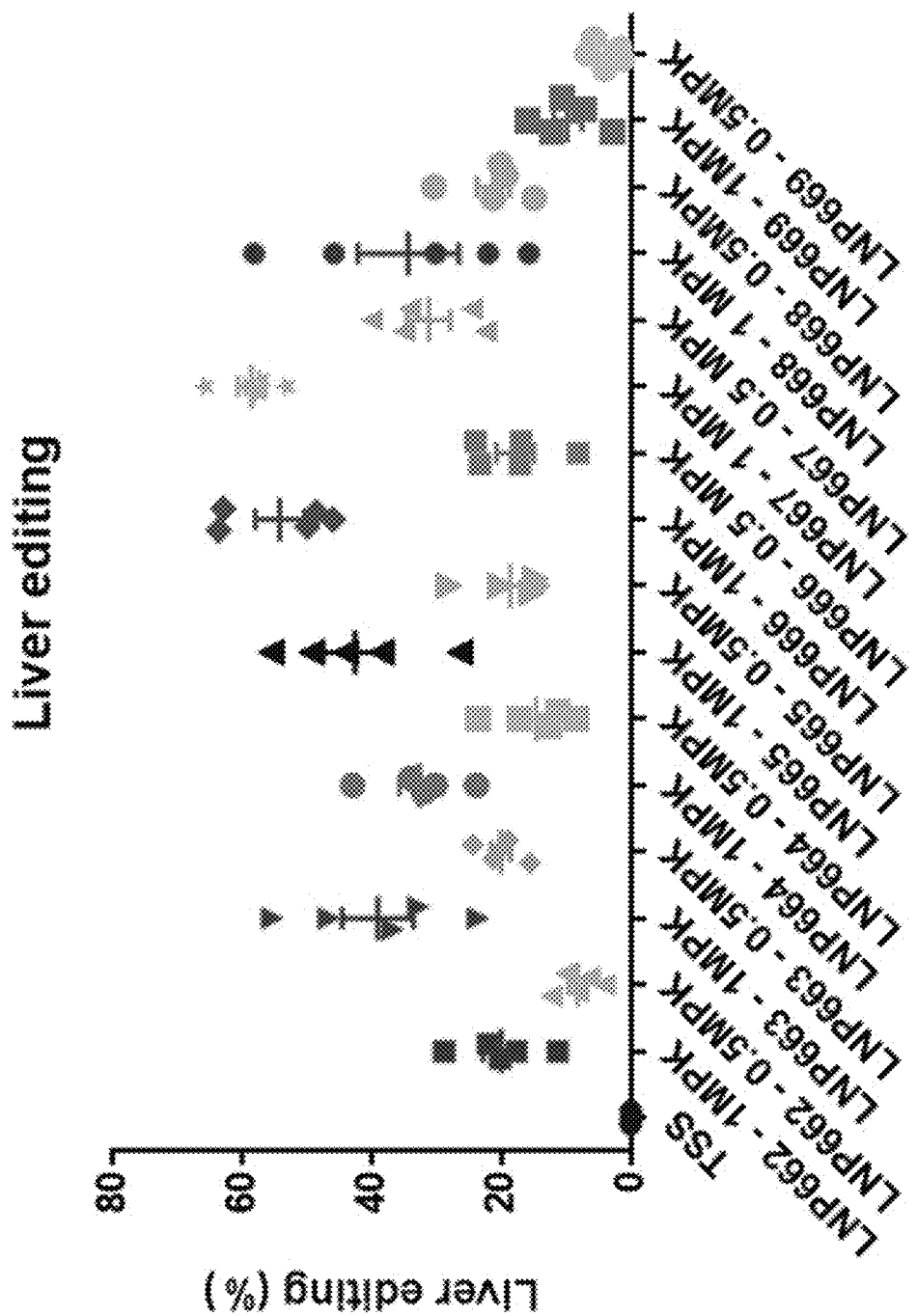
Figure 13D:
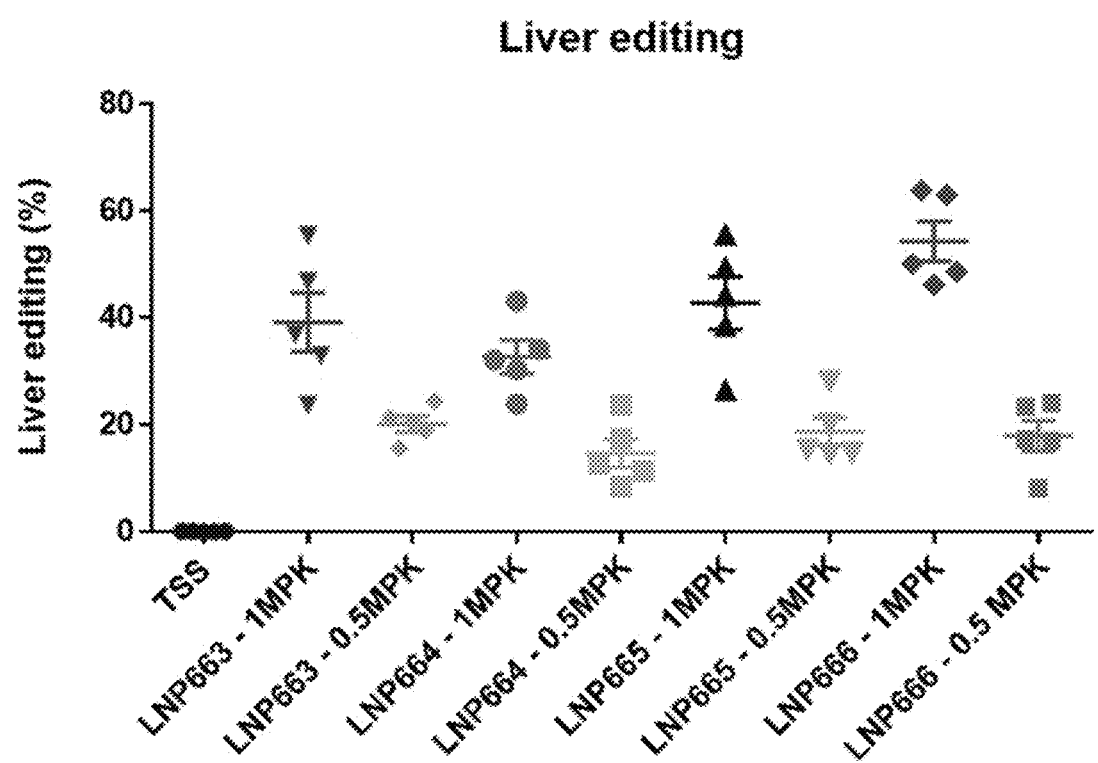
Figure 13E:
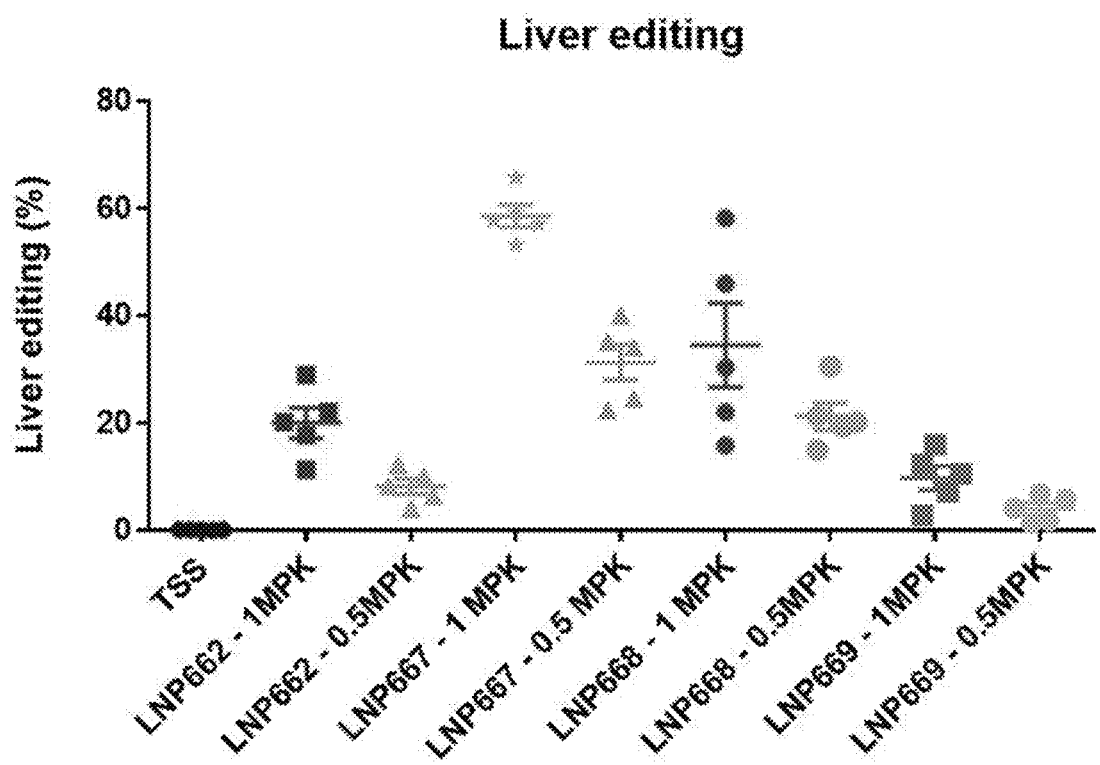

FIGS. 13A-E show serum TTR (as μg/ml in FIG. 13A and % of TSS in FIG. 13B); liver editing for all of LNPs 662-669 (FIG. 13C); liver editing for LNP663-LNP666 in which only the UTRs varied (FIG. 13D); and liver editing for LNP662 and LNP667-LNP669 in which only the mRNA sequence and UTP modification varied (FIG. 13E).

The human albumin, human alpha globin, human beta globin and *xenopus* beta globin UTRs were approximately equally effective; values with the human alpha globin may be slightly lower but it was unclear whether the difference was significant.

The ORF of SEQ ID NO: 4, which contains fewer uridines, increased the amount of editing in the liver. The Cas9 mRNAs made with N1-methyl pseudouridine were more effective than the Cas9 mRNAs made with unmodified uridine.

7. In Vitro and In Vivo Editing with Different Guide:Cas9 Ratios mRNAs comprising an ORF according to SEQ ID NO: 4 or SEQ ID NO: 5 were formulated as LNPs with a guide RNA targeting TTR, with varying guide:Cas9 mRNA weight ratios as shown in Table 16. Cas9 mRNA was made by IVT synthesis as indicated above with N1-methylpseudouridine triphosphate in place of uridine triphosphate, HSD 5' UTR, human albumin 3' UTR, and a poly-A tail.

TABLE 16

LNPs 815-824 for in vitro and in vivo studies

| LNP | Cas9 SEQ ID NO | RNA Ratio (Guide:Cas9) |
|---|---|---|
| LNP815 | 5 | 2:1 |
| LNP816 | 5 | 1:1 |
| LNP817 | 5 | 1:2 |
| LNP818 | 5 | 1:4 |
| LNP819 | 5 | 1:8 |
| LNP820 | 4 | 2:1 |
| LNP821 | 4 | 1:1 |
| LNP822 | 4 | 1:2 |
| LNP823 | 4 | 1:4 |
| LNP824 | 4 | 1:8 |

Figure 14:
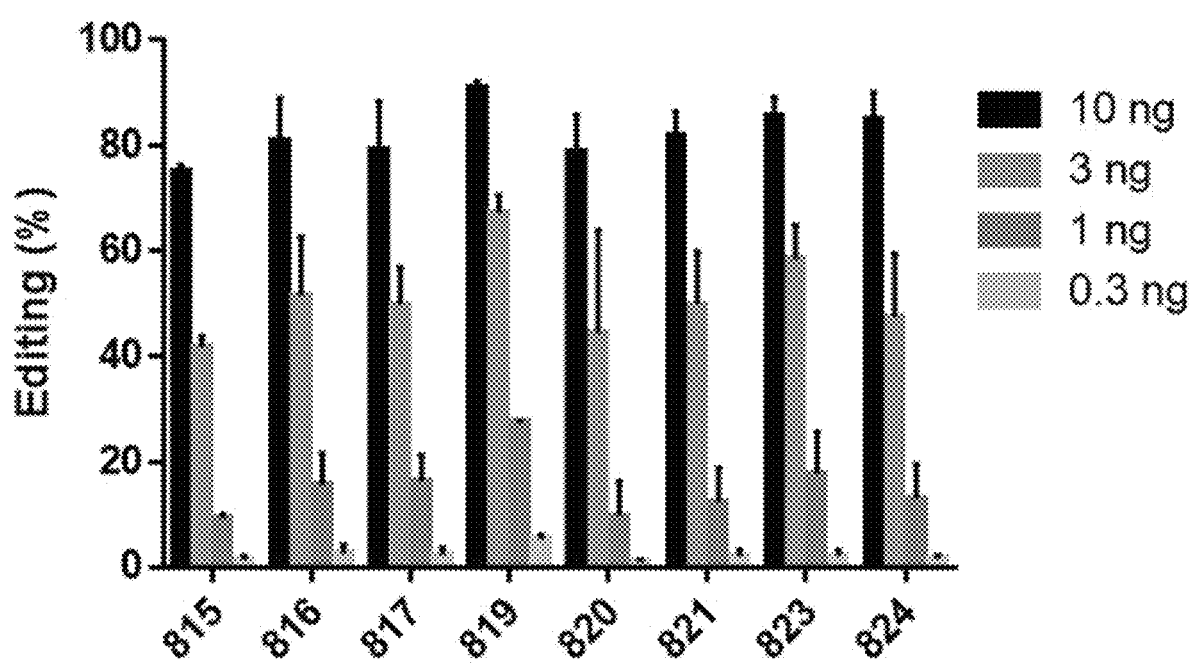
FIG. 14 shows percentage of TTR editing in primary mouse hepatocytes (PMH) treated with 0.3, 1, 3, or 10 ng of LNP815-821, 823, or 824.

Primary mouse hepatocytes (PMH) were plated in culture media supplemented with 3% cynomolgus monkey serum for 24 hours and then treated with 0.3, 1, 3, or 10 ng of an LNP shown in Table 16. Cells were lysed after 48 hr and % editing was determined by NGS. Results are shown in FIG. 14 and Table 17.

TABLE 17

In vitro editing in PMHs

| LNP | mRNA | Guide:mRNA ratio | 10 ng | 3 ng | 1 ng | 0.3 ng |
|---|---|---|---|---|---|---|
| LNP815 | 5 | 2:1 | 75.0 | 41.7 | 9.3 | 1.3 |
| LNP816 | 5 | 1:1 | 80.9 | 51.5 | 15.5 | 2.6 |
| LNP817 | 5 | 1:2 | 79.1 | 49.8 | 16.3 | 2.2 |
| LNP819 | 5 | 1:8 | 90.7 | 67.2 | 27.8 | 5.2 |
| LNP820 | 4 | 2:1 | 78.8 | 44.3 | 9.8 | 0.9 |
| LNP821 | 4 | 1:1 | 81.9 | 49.9 | 12.3 | 2.1 |
| LNP823 | 4 | 1:4 | 85.5 | 58.3 | 17.8 | 2.0 |
| LNP824 | 4 | 1:8 | 84.9 | 47.4 | 13.1 | 1.6 |

Figure 15A:
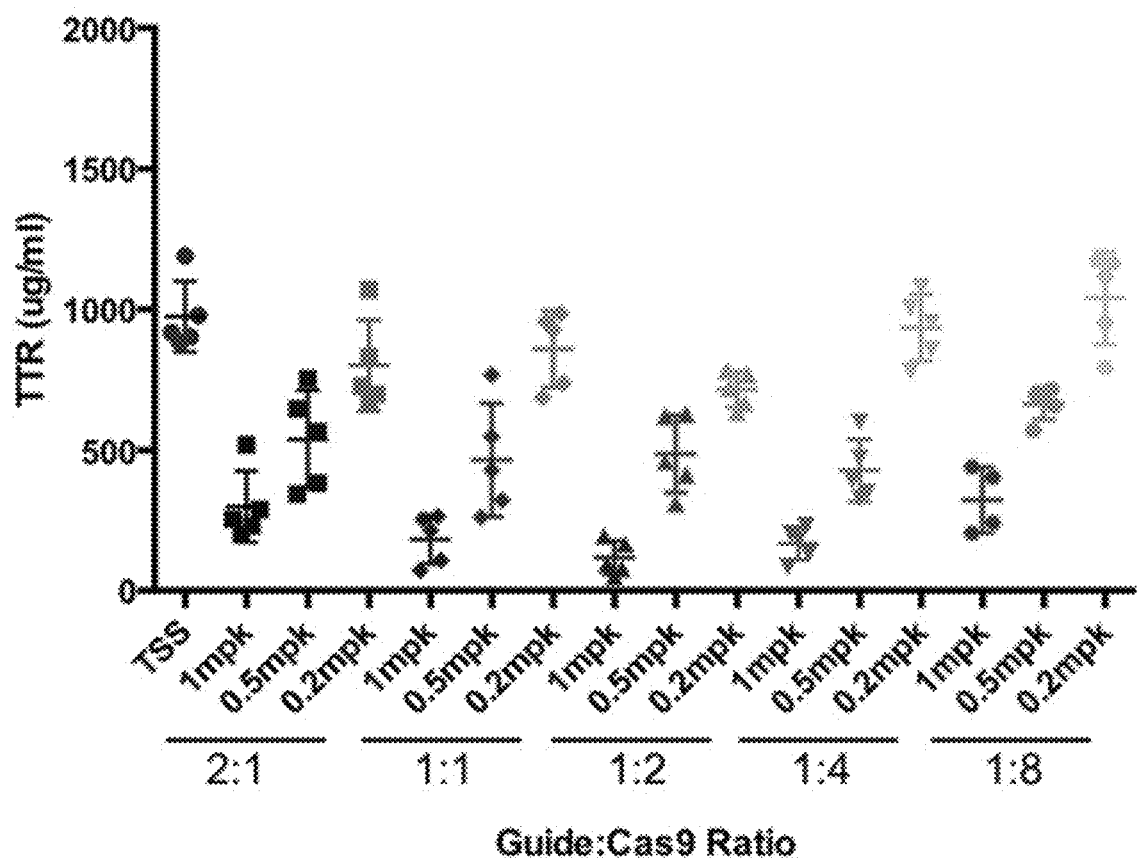
FIGS. 15A-B show serum TTR levels following dosing of LNP formulations containing a Cas9 mRNA in which the ORFs had the sequence of SEQ ID NO: 5 or 4 at the indicated Guide:Cas9 ratios and amounts.
Figure 15B:
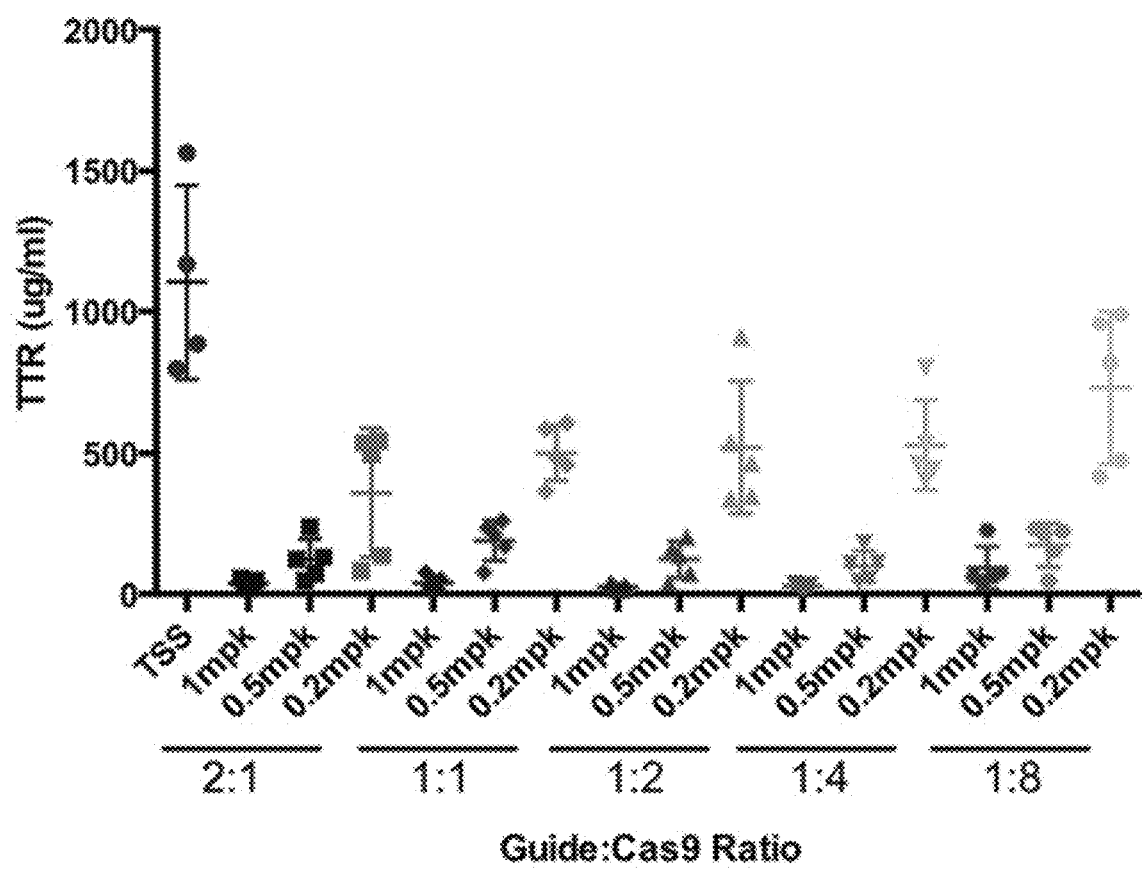
Figure 16A:
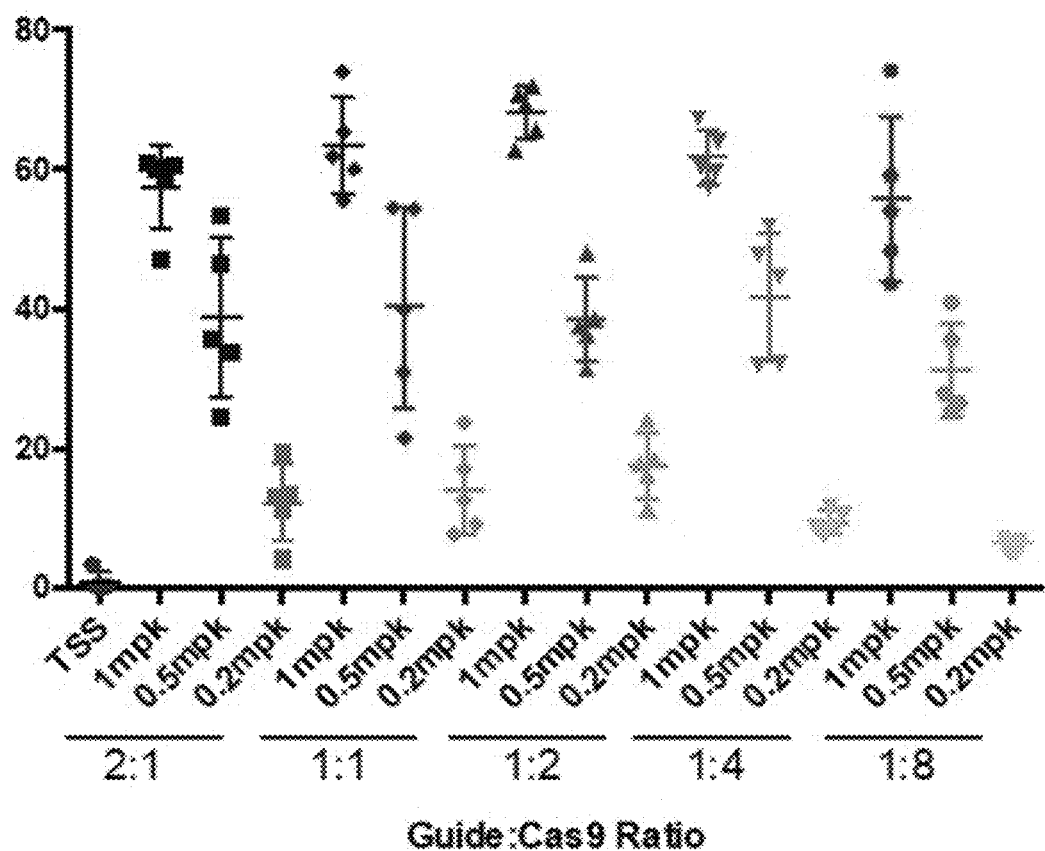
FIGS. 16A-B show percentage of TTR editing in liver following dosing of LNP formulations containing a Cas9 mRNA in which the ORFs had the sequence of SEQ ID NO: 5 or 4 at the indicated Guide:Cas9 ratios and amounts.
Figure 16B:
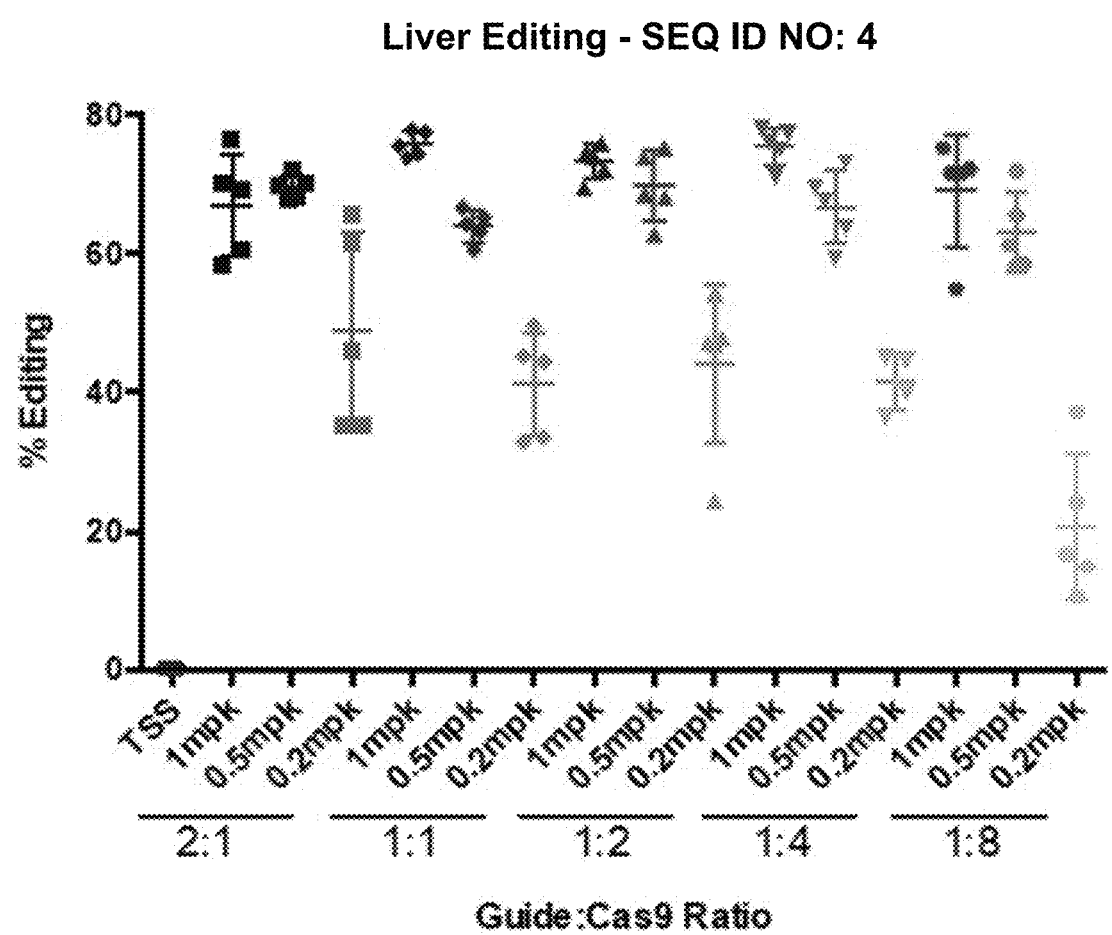
Figure 17A:
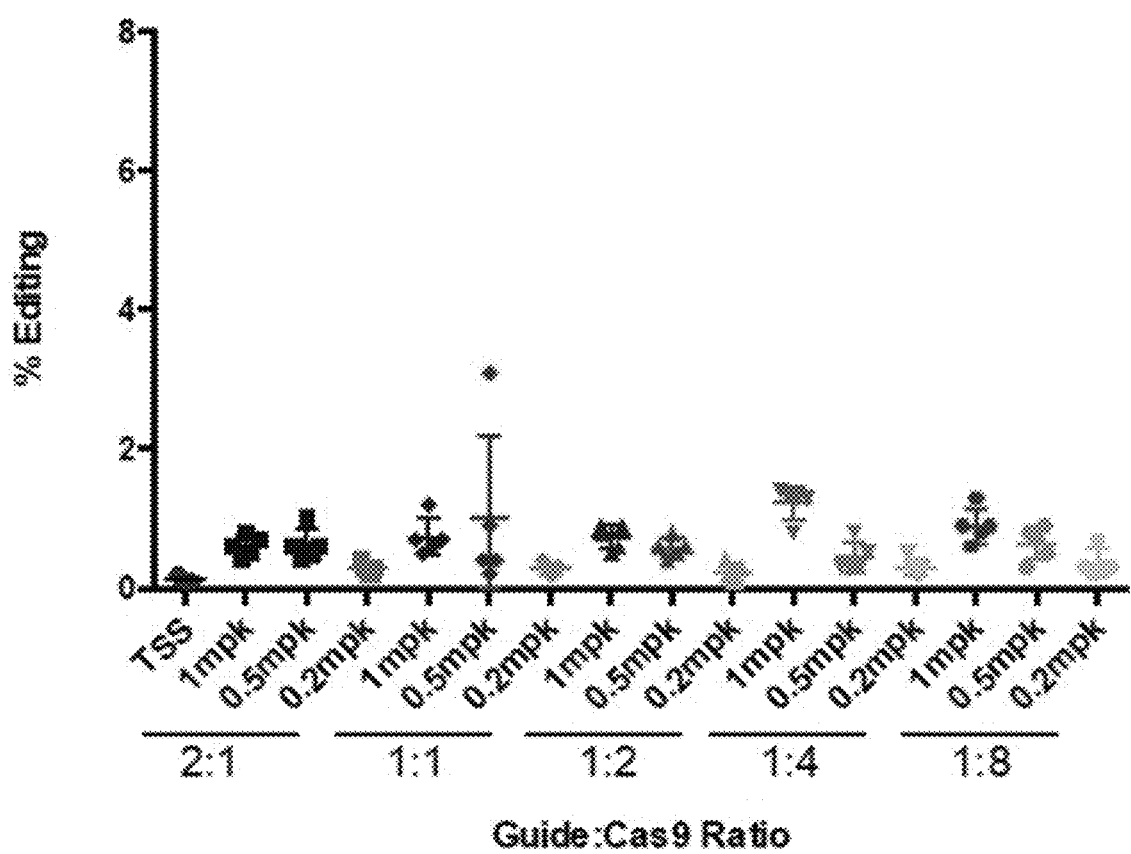
FIGS. 17A-B show percentage of TTR editing in spleen following dosing of LNP formulations containing a Cas9 mRNA in which the ORFs had the sequence of SEQ ID NO: 5 or 4 at the indicated Guide:Cas9 ratios and amounts.
Figure 17B:
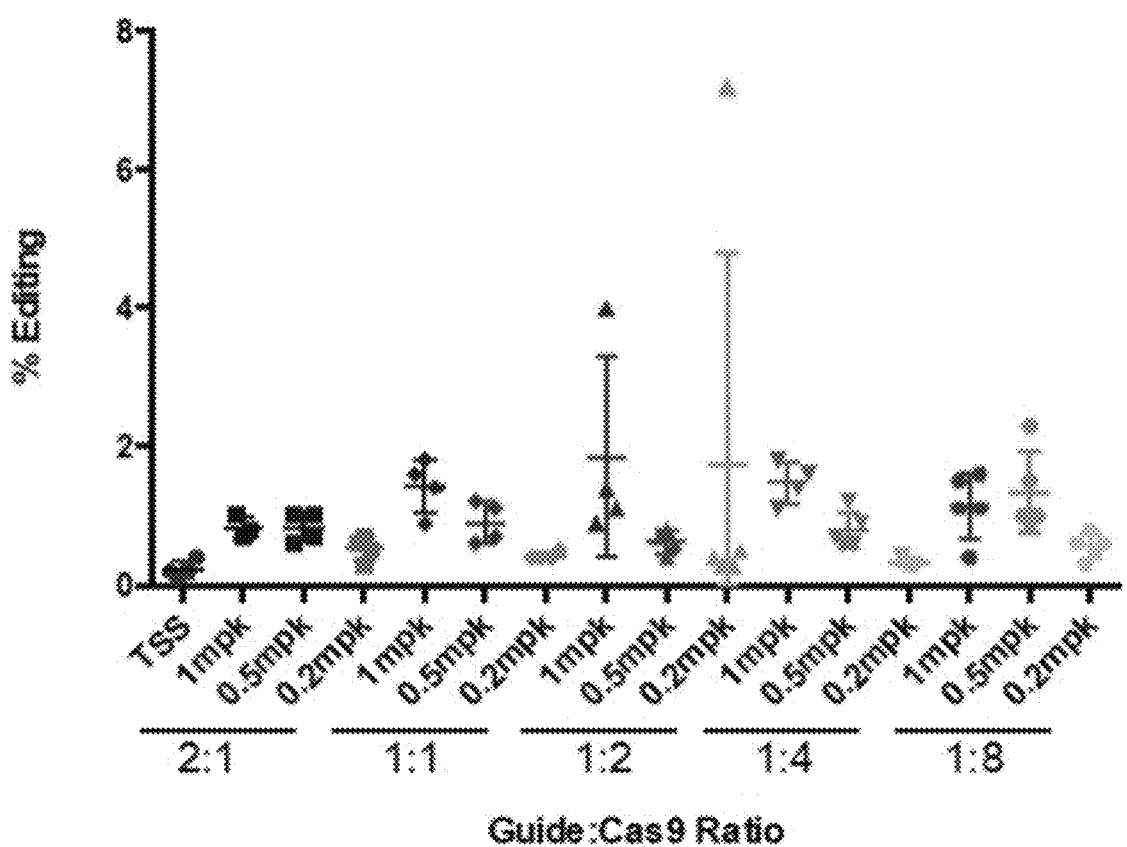

For in vivo characterization, LNPs were administered to mice at 0.2, 0.5, or 1 mpk (n=5 per group). At 8 days post-dose, animals were sacrificed, blood and the liver and spleen were collected, and serum TTR, liver editing, and spleen editing were measured. Serum TTR results are shown in FIGS. 15A-B and Table 18. Liver editing results are shown in FIGS. 16A-B and Table 19. Spleen editing results are shown in FIGS. 17A-B and Table 20. Negative control mice were dosed with vehicle (transformation and storage solution; "TSS"). Separate controls were run for the experiments with LNP815-LNP819 and for the experiments with LNP820-LNP824.

TABLE 18

Serum TTR levels following dosing with LNP815-LNP824

| LNP | Guide:Cas9 Ratio | Dose (mpk) | Serum TTR (ug/mL) | Serum TTR (%KD) |
|---|---|---|---|---|
| TSS | | | 974.23 | — |
| LNP815 | 2:1 | 1 | 300.32 | 69.17 |
| | | 0.5 | 539.37 | 44.64 |
| | | 0.2 | 800.85 | 17.80 |
| LNP816 | 1:1 | 1 | 183.61 | 81.15 |
| | | 0.5 | 466.63 | 52.10 |
| | | 0.2 | 859.05 | 11.82 |
| LNP817 | 1:2 | 1 | 117.86 | 87.90 |
| | | 0.5 | 487.26 | 49.99 |
| | | 0.2 | 715.35 | 26.57 |
| LNP818 | 1:4 | 1 | 168.44 | 82.71 |
| | | 0.5 | 428.89 | 55.98 |
| | | 0.2 | 935.14 | 4.01 |
| LNP819 | 1:8 | 1 | 323.87 | 72.29 |
| | | 0.5 | 664.80 | 31.76 |
| | | 0.2 | 1039.66 | −6.72 |
| TSS | | | 1104.27 | — |
| LNP820 | 2:1 | 1 | 38.12 | 96.55 |
| | | 0.5 | 122.59 | 88.90 |
| | | 0.2 | 358.88 | 67.50 |
| LNP821 | 1:1 | 1 | 38.53 | 96.51 |
| | | 0.5 | 190.30 | 82.77 |
| | | 0.2 | 501.05 | 54.63 |
| LNP822 | 1:2 | 1 | 25.76 | 97.67 |
| | | 0.5 | 123.34 | 88.83 |
| | | 0.2 | 520.73 | 52.84 |
| LNP823 | 1:4 | 1 | 28.00 | 97.46 |
| | | 0.5 | 98.99 | 91.04 |
| | | 0.2 | 529.35 | 52.06 |
| LNP824 | 1:8 | 1 | 93.65 | 91.52 |
| | | 0.5 | 174.43 | 84.20 |
| | | 0.2 | 731.43 | 33.76 |

% KD gives the % knock down in TTR level relative to the TSS control.

TABLE 19

Liver editing following dosing with LNP815-LNP824

| LNP | Guide:Cas9 Ratio | Dose (MPK) | % Editing |
|---|---|---|---|
| TSS | | | 0.78 |
| LNP815 | 2:1 | 1 | 57.52 |
| | | 0.5 | 38.76 |
| | | 0.2 | 12.28 |
| LNP816 | 1:1 | 1 | 63.46 |
| | | 0.5 | 40.26 |
| | | 0.2 | 14.12 |
| LNP817 | 1:2 | 1 | 68.18 |
| | | 0.5 | 38.38 |
| | | 0.2 | 17.58 |
| LNP818 | 1:4 | 1 | 61.8 |
| | | 0.5 | 41.58 |
| | | 0.2 | 9.44 |
| LNP819 | 1:8 | 1 | 55.88 |
| | | 0.5 | 31.26 |
| | | 0.2 | 6.4 |
| TSS | | | 0.22 |
| LNP820 | 2:1 | 1 | 67 |
| | | 0.5 | 69.58 |
| | | 0.2 | 48.78 |
| LNP821 | 1:1 | 1 | 75.82 |
| | | 0.5 | 64.02 |
| | | 0.2 | 41.2 |
| LNP822 | 1:2 | 1 | 73.26 |
| | | 0.5 | 69.74 |
| | | 0.2 | 44.16 |
| LNP823 | 1:4 | 1 | 75.48 |
| | | 0.5 | 66.7 |
| | | 0.2 | 38.7 |
| LNP824 | 1:8 | 1 | 69.14 |
| | | 0.5 | 63.16 |
| | | 0.2 | 20.78 |

LNP820-LNP824 generally gave liver editing results greater than or approximately equal to their LNP815-LNP819 counterparts with the same ratio. LNP820-LNP824 showed consistent performance across the range of ratios tested at 0.5 and 1 mpk, and across ratios from 2:1 to 1:4 at 0.2 mpk.

TABLE 20

Spleen editing following dosing with LNP815-824

| LNP | Guide:Cas9 Ratio | Dose (MPK) | % Editing |
|---|---|---|---|
| TSS | | | 0.12 |
| LNP815 | 2:1 | 1 | 0.6 |
| | | 0.5 | 0.62 |
| | | 0.2 | 0.28 |
| LNP816 | 1:1 | 1 | 0.74 |
| | | 0.5 | 1 |
| | | 0.2 | 0.28 |
| LNP817 | 1:2 | 1 | 0.74 |
| | | 0.5 | 0.58 |
| | | 0.2 | 0.22 |
| LNP818 | 1:4 | 1 | 1.22 |
| | | 0.5 | 0.44 |
| | | 0.2 | 0.3 |
| LNP819 | 1:8 | 1 | 0.9 |
| | | 0.5 | 0.64 |
| | | 0.2 | 0.36 |
| TSS | | | 0.225 |
| LNP820 | 2:1 | 1 | 0.83 |
| | | 0.5 | 0.825 |
| | | 0.2 | 0.525 |
| LNP821 | 1:1 | 1 | 1.425 |
| | | 0.5 | 0.9 |
| | | 0.2 | 0.425 |
| LNP822 | 1:2 | 1 | 1.85 |
| | | 0.5 | 0.625 |
| | | 0.2 | 1.74 |
| LNP823 | 1:4 | 1 | 1.475 |
| | | 0.5 | 0.8 |
| | | 0.2 | 0.32 |
| LNP824 | 1:8 | 1 | 1.14 |
| | | 0.5 | 1.34 |
| | | 0.2 | 0.56 |

Figure 18:
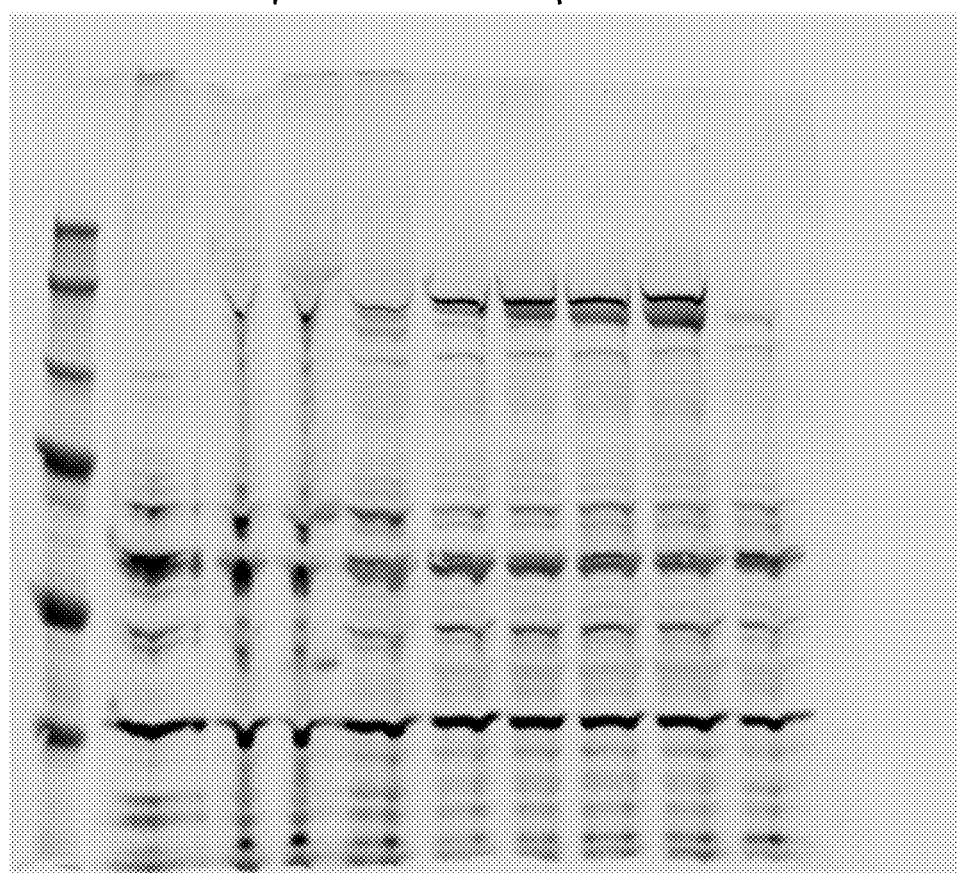
FIG. 18 shows a Western blot for Cas9 expression in liver following dosing of LNP formulations containing a Cas9 mRNA in which the ORFs had the sequence of SEQ ID NO: 5 or 4 at the indicated Guide:Cas9 ratios.

Additional groups of mice (n=2) were dosed at 3 mpk with each formulation and sacrificed at 6 hpd for determination of protein expression in liver. A Western blot of liver protein from the mice treated with 3 mpk of 1:1 and 1:4 ratio formulations (LNP816, LNP818, LNP821, and LNP823) is shown in FIG. 18. The primary Ab for the Western was Immunoprecise™ rabbit anti-Cas9 at 1:5,000 and the secondary Ab was Dylight™ goat anti-rabbit at 1:12,500. Cas9 protein expression was noticeably higher in the LNPs using the mRNA with an ORF of SEQ ID NO: 4.

8. Characterization of Effects of Modified Nucleotides mRNAs encoding Cas9 and containing modified nucleotides as indicated in Table 21 were formulated as LNPs with a guide RNA targeting TTR (G282; SEQ ID NO: 42). LNP1034 contained a Cas9 mRNA obtained commercially from Trilink Biotechnologies, LLC and included a CleanCap™ (Cap1 structure in which the first nucleotide after the 7-methylguanine cap is 2'-O-methylated). LNP1027-LNP1033 contained an mRNA comprising an ORF according to SEQ ID NO: 4 and an ARCA (anti-reverse cap analogue) Cap0. The LNPs were assembled using a Nano Assemblr™, contained 45% Lipid A, 9% DSPC, 44% cholesterol, and 2% PEG2k-DMG, were purified using Amicon PD10 filters, and were suspended in TSS buffer. The N:P (nitrogen to phosphate) ratio in the LNPs was 4.5 and the RNA concentration of the formulations was 0.4 mg/ml. CD-1 female mice (n=5 per group) were dosed i.v. at 0.1 or 0.3 mpk. At 7 days post-dose, animals were sacrificed, blood and the liver were collected, and serum TTR and liver editing were measured.

TABLE 21

LNP1027-LNP1034 for in vivo studies

| LNP ID | Cas9 ORF | Cap | Modified nucleotide(s) |
|---|---|---|---|
| LNP1027 | SEQ ID NO: 4 | ARCA | N1-methyl pseudouridine |
| LNP1028 | SEQ ID NO: 4 | ARCA | 25% 5-iodouridine |
| LNP1029 | SEQ ID NO: 4 | ARCA | 50% 5-iodouridine |
| LNP1030 | SEQ ID NO: 4 | ARCA | 25% 5-iodocytidine |
| LNP1031 | SEQ ID NO: 4 | ARCA | 25% 5-iodouridine and 25% 5-iodocytidine |
| LNP1032 | SEQ ID NO: 4 | ARCA | Pseudouridine |
| LNP1033 | SEQ ID NO: 4 | ARCA | Pseudouridine and 5-methyl cytidine |
| LNP1034 | Trilink Cas9 mRNA | CleanCap ™ | 5-methoxy uridine |

For LNPs in which modified uridine and/or cytidine nucleotides are listed at 25% or 50%, the remainders of the uridine and/or cytidine, respectively, were unmodified.

Figure 19A:
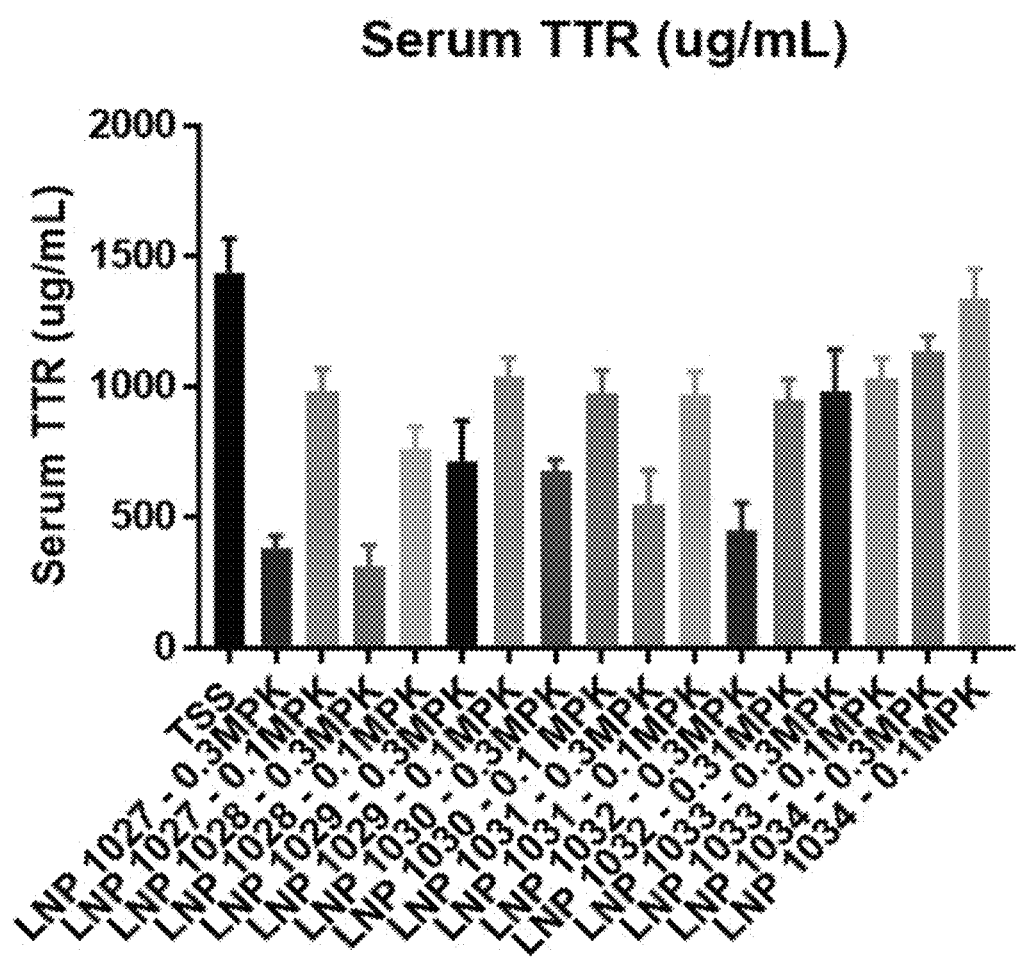
FIGS. 19A-B show serum TTR levels following dosing of the indicated LNP formulations at the indicated amounts.
Figure 19B:
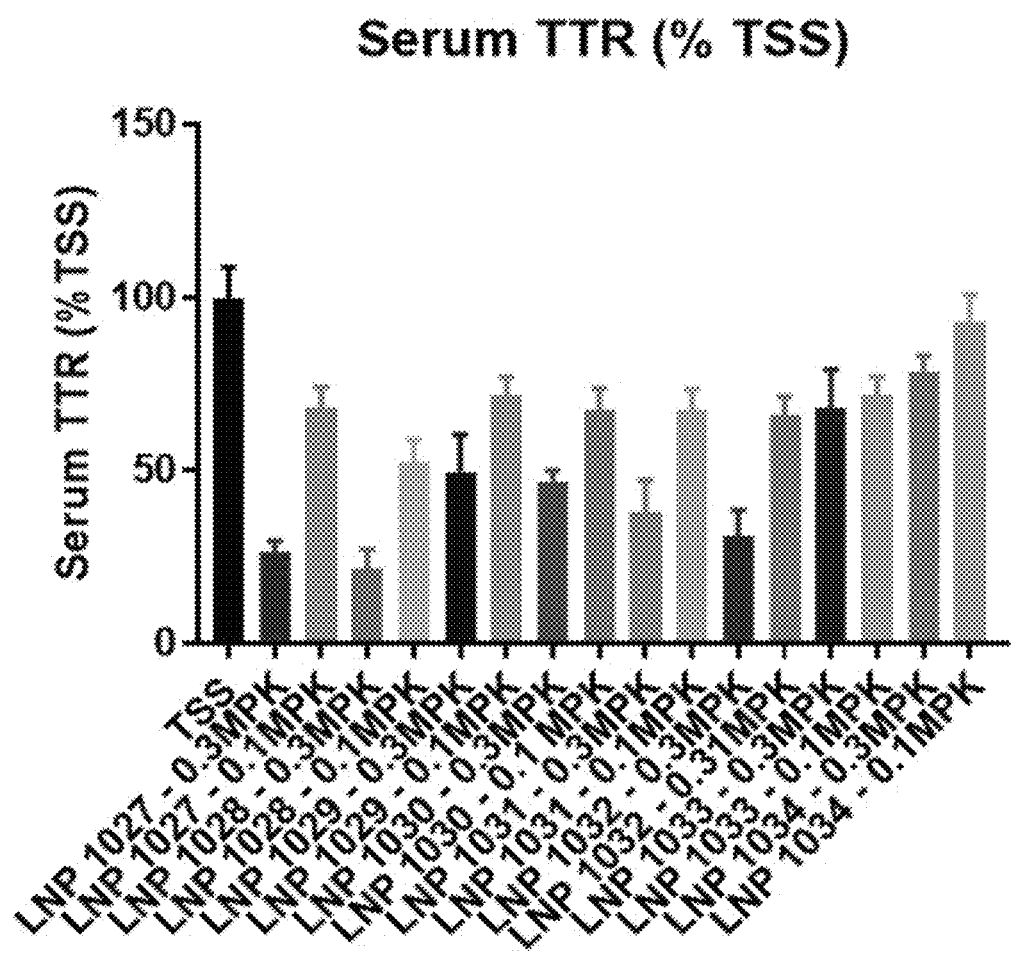
Figure 20:
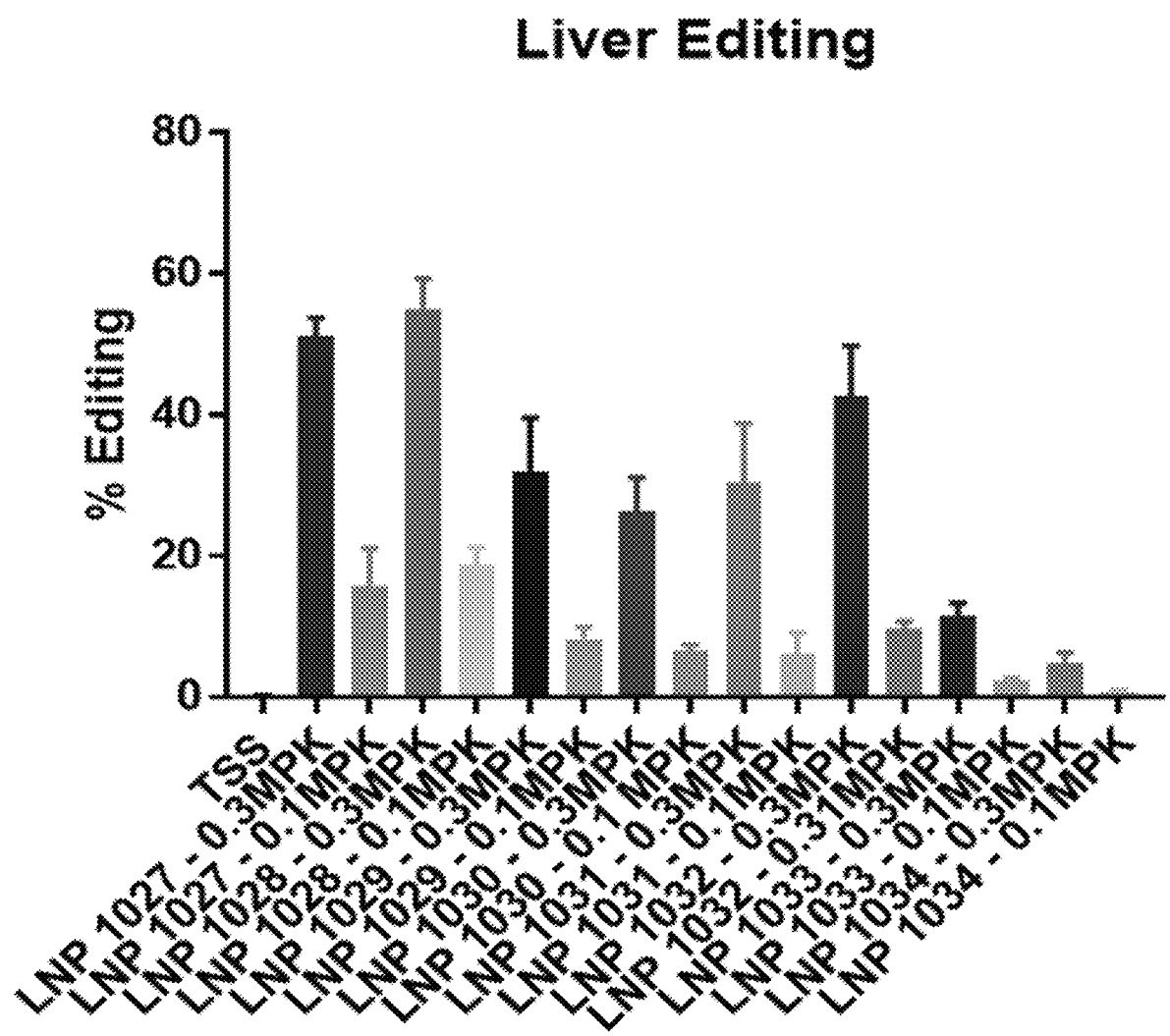
FIG. 20 shows percentage of TTR editing in liver following dosing of the indicated LNP formulations at the indicated amounts.

Serum TTR results are shown in FIG. 19A-B (serum TTR results expressed in μg/mL and % of TSS control, respectively); FIG. 20 (liver editing); and Table 22.

The N1-methyl pseudouridine-containing mRNA of LNP1027 had slightly higher editing efficiency compared to the pseudouridine-containing mRNA of LNP1032. The potency of mRNA containing both pseudouridine and 5-methylcytidine (LNP1033) was greatly reduced. The mRNA containing 25% 5-iodouridine showed equivalent editing efficiency to the N1-methyl pseudouridine-containing mRNA. At 50% 5-iodouridine, there was a reduction in potency. The 5-methoxyuridine mRNA from Trilink showed low activity.

9. Characterization of Effects of mRNAs with Different UTRs in Rats

This study evaluated in vivo efficacy in rats of ARCA capped Cas9 mRNAs with HBB (human beta-globin) 5' and 3' UTRs; XBG (*xenopus* beta-globin) 5' and 3' UTRs; or with the human HSL17B4 (HSD) 5' UTR and albumin (ALB) 3' UTR.

Formulations containing guide RNA targeting the rat TTR gene (G534; SEQ ID NO: 72) and Cas9 mRNA in a 1:1 molar ratio in LNPs were prepared using the cross-flow process described above and filtered on VivaFlow™ 50 membranes. LNPs contained a cationic lipid (Lipid A), cholesterol, DSPC, and PEG2k-DMG in a 45:9:43:3 molar ratio and had an N:P ratio of 6.0. Formulations were dosed at 1 mpk and 0.3 mpk. All rats were Sprague Dawley Females from Charles River, n=5 per group. At necropsy (7 days post dose), serum was collected for TTR analysis and liver was collected for editing analysis. In LNP1058, the mRNA contained HBB UTRs. In LNP1059, the mRNA contained XBG UTRs. In LNP1060, the mRNA contained HSD and ALB 5' and 3' UTRs, respectively. In all cases the mRNA coding sequence was according to SEQ ID NO: 4.

Figure 21A:
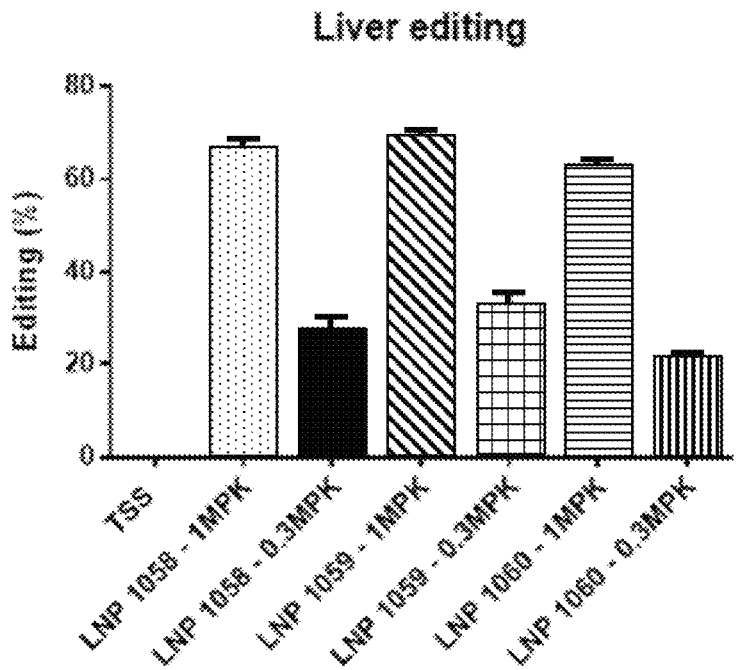
FIGS. 21A-C show levels of liver editing (A) and serum TTR (B in µg/ml; C as percentage of TSS control) following dosing of the indicated LNP formulations at the indicated amounts.
Figure 21B:
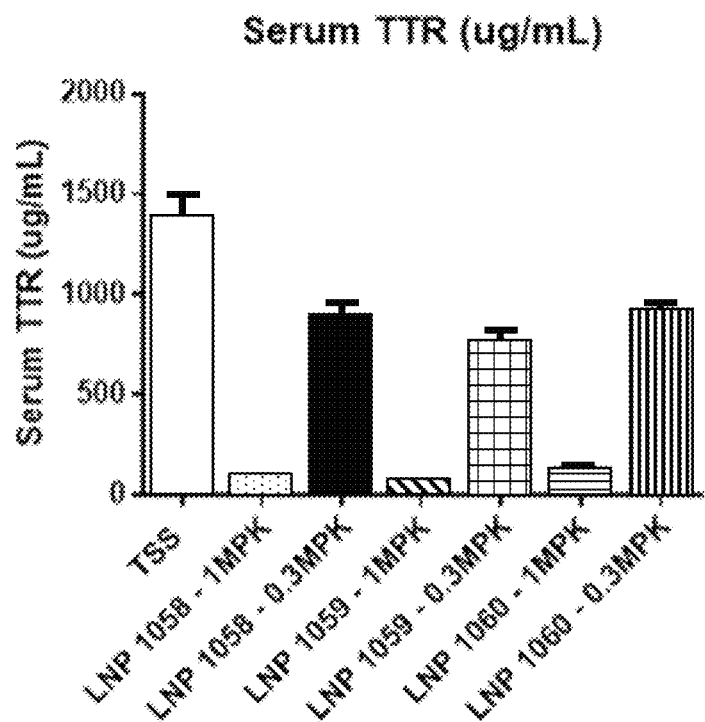
Figure 21C:
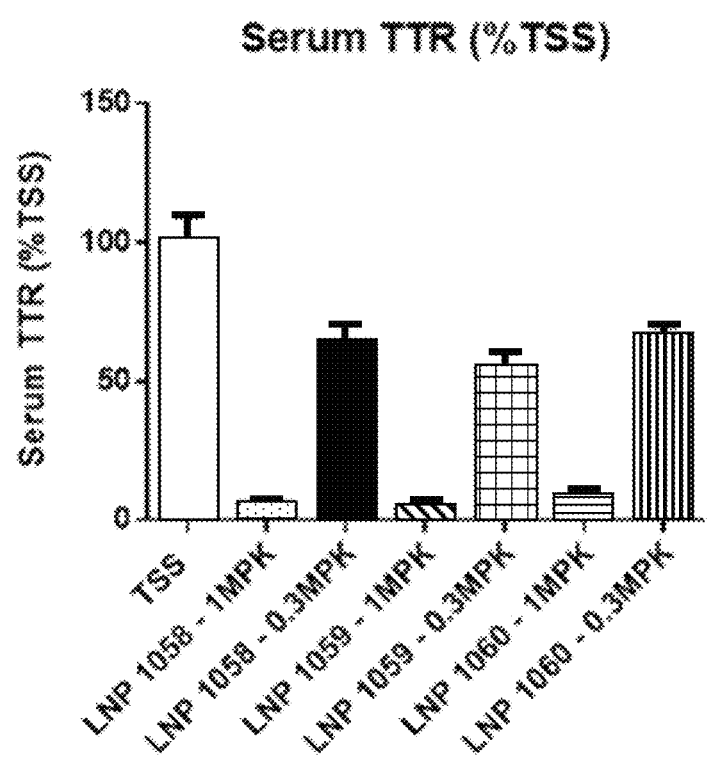

Liver editing and serum TTR results are shown in FIG. 21A-C and Table 23.

TABLE 22

Serum TTR and liver editing results for LNPs 1027-1034

| LNP ID | Dose (mpk) | Modified nucleotide(s) | Serum TTR (ug/mL) | Serum TTR (% KD) | Average % Editing |
|---|---|---|---|---|---|
| TSS | — | — | 1438.438 | — | 0.20 |
| LNP1027 | 0.3 | N1-methyl pseudouridine | 381.474 | 73.48 | 51.08 |
| | 0.1 | | 979.404 | 31.91 | 15.76 |
| LNP1028 | 0.3 | 25% 5-iodouridine | 311.738 | 78.33 | 54.96 |
| | 0.1 | | 758.41 | 47.28 | 18.82 |
| LNP1029 | 0.3 | 50% 5-iodouridine | 714.748 | 50.31 | 31.94 |
| | 0.1 | | 1034.69 | 28.07 | 8.26 |
| LNP1030 | 0.3 | 25% 5-iodocytidine | 676.164 | 52.99 | 26.28 |
| | 0.1 | | 973.836 | 32.30 | 6.58 |
| LNP1031 | 0.3 | 25% 5-iodouridine and | 546.946 | 61.98 | 30.30 |
| | 0.1 | 25% 5-iodocytidine | 969.92 | 32.57 | 6.12 |
| LNP 1032 | 0.3 | Pseudouridine | 448.582 | 68.81 | 42.68 |
| | 0.1 | | 947.602 | 34.12 | 9.60 |
| LNP1033 | 0.3 | Pseudouridine and 5-methyl cytidine | 979.284 | 31.92 | 11.36 |
| | 0.1 | | 1031.33 | 28.30 | 2.22 |
| LNP 1034 | 0.3 | 5-methoxy uridine | 1133.826 | 21.18 | 4.82 |
| | 0.1 | | 1339.304 | 6.89 | 0.78 |

TABLE 23

Liver Editing and Serum TTR results in Rats with LNP1058-LNP1060.

| LNP | UTRs | Dose (mpk) | Liver editing (%) | Serum TTR (gg/ml) | Serum TTR (% KD) |
|---|---|---|---|---|---|
| TSS | | | 0.0 | 1366.9 | |
| 1058 | HBB (3' and 5') | 1 | 66.3 | 84.4 | 93.8 |
| | | 0.3 | 27.6 | 881.1 | 35.5 |
| 1059 | XBG (3' and 5') | 1 | 69.1 | 63.0 | 95.4 |
| | | 0.3 | 31.6 | 748.7 | 45.2 |
| 1060 | HSD (5') and ALB (3') | 1 | 62.6 | 115.6 | 91.5 |
| | | 0.3 | 20.9 | 896.0 | 34.4 |

The results indicate that all tested mRNAs in LNP1058-LNP1060 were able to support editing. The highest level of editing and the greatest decrease in serum TTR was seen with the mRNA containing XBG UTRs in LNP1059.

10. RNA Cargo: mRNA and gRNA Coformulations

This study evaluated in vivo efficacy in mice of different ratios of gRNA to mRNA. CleanCap™ capped Cas9 mRNAs with the ORF of SEQ ID NO: 4, HSD 5' UTR, human albumin 3' UTR, a Kozak sequence, and a poly-A tail were made by IVT synthesis as indicated in Example 1 with N1-methylpseudouridine triphosphate in place of uridine triphosphate.

LNP formulations were prepared from the mRNA described and sg282 (SEQ ID NO: 42; G282) as described in Example 2 with Lipid A, cholesterol, DSPC, and PEG2k-DMG in a 55:33:9:3 molar ratio and with an N:P ratio of 6. The gRNA:Cas9 mRNA weight ratios of the formulations were as shown in Table 24.

TABLE 24

Characterization of LNP1110-LNP1116.

| LNP ID | RNA Conc (mg/mL) | EE (%) | Particle Size (nm) | Particle PDI | Number Ave (nm) |
|---|---|---|---|---|---|
| 1110 | 0.92 | 99 | 69.52 | 0.022 | 56.47 |
| 1111 | 0.86 | 97 | 76.65 | 0.065 | 57.36 |
| 1112 | 0.90 | 99 | 76.58 | 0.036 | 63.11 |
| 1113 | 0.97 | 99 | 76.60 | 0.071 | 58.92 |
| 1114 | 1.05 | 99 | 76.34 | 0.018 | 62.82 |
| 1115 | 0.65 | 99 | 82.64 | 0.018 | 66.63 |
| 1116 | 0.75 | 100 | 82.01 | 0.039 | 65.05 |

Figure 22A:
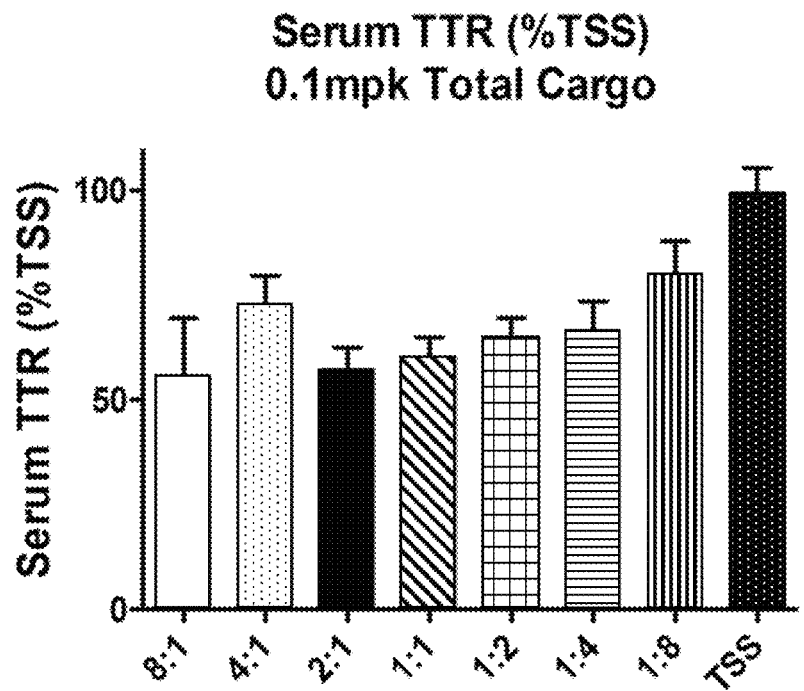
FIGS. 22A-D show serum TTR and editing results following dosing of LNP formulations at the indicated ratios and amounts.
Figure 22B:
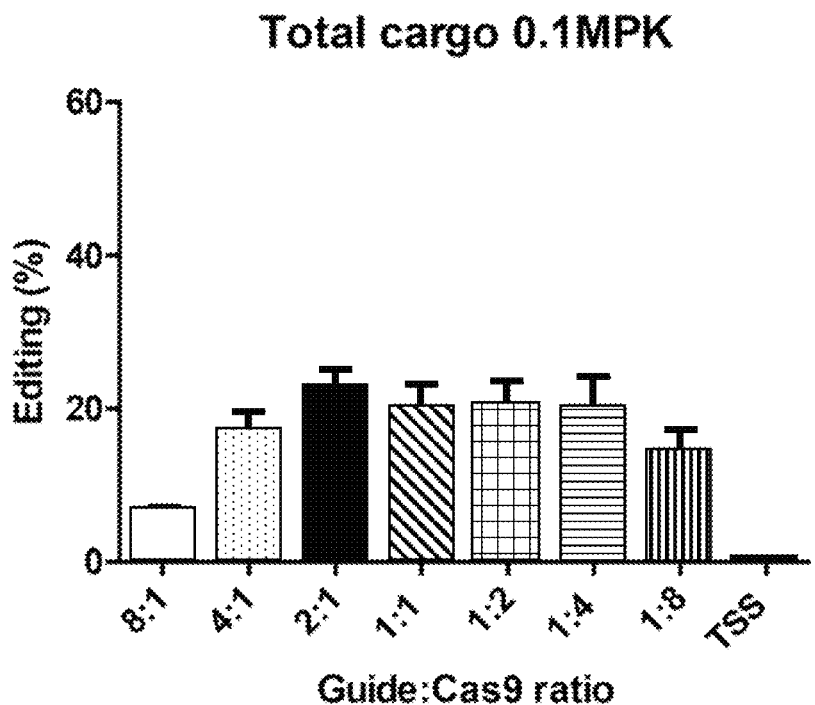

For in vivo characterization, the above LNPs were administered to mice at 0.1 mg total RNA (mg guide RNA+mg mRNA) per kg (n=5 per group). At 7-9 days post-dose. Animals were sacrificed, blood and the liver were collected, and serum TTR and liver editing were measured as described above. Serum TTR and liver editing results are shown in FIG. 22A and FIG. 22B. Negative control mice were dosed with TSS vehicle.

Figure 22C:
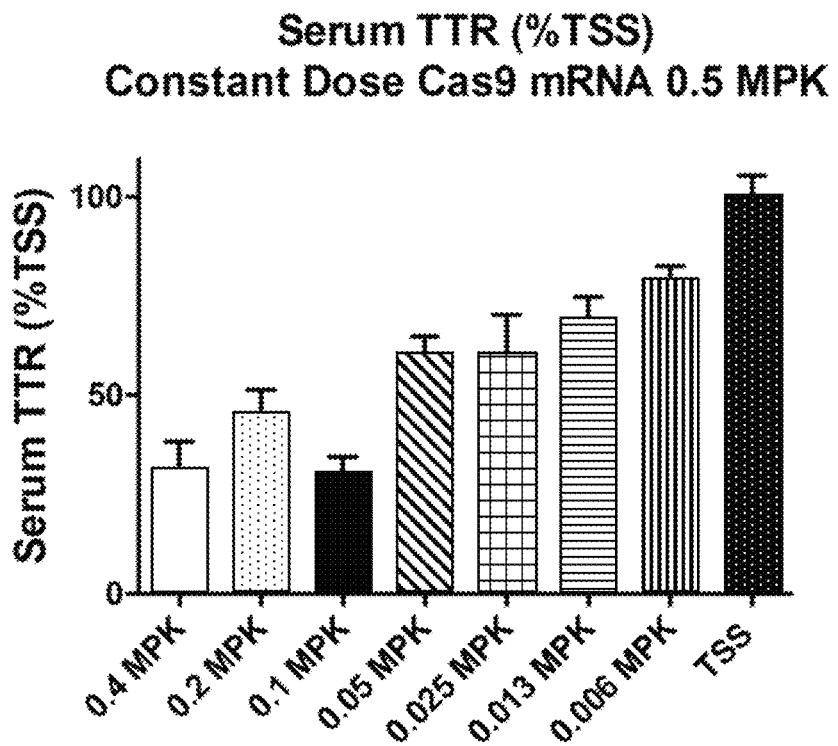
Figure 22D:
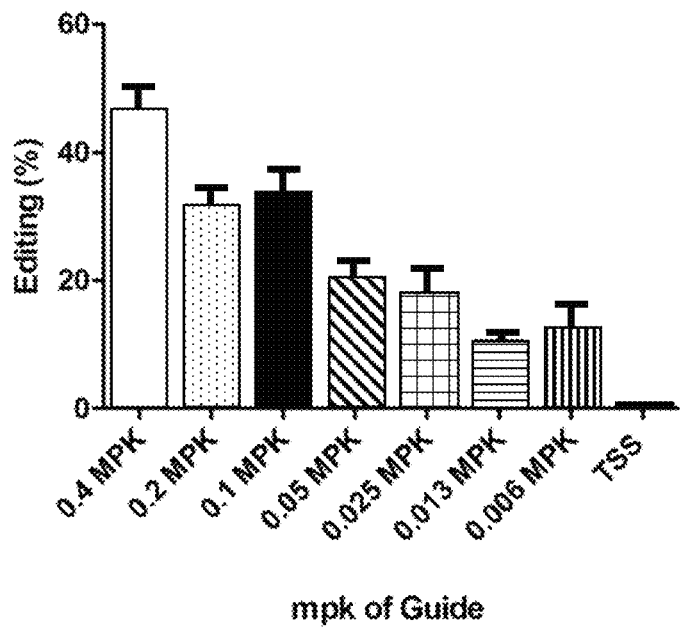

In addition, the above LNPs were administered to mice at a constant mRNA dose of 0.05 mg mRNA per kg (n=5 per group), while varying the gRNA dose from 0.06 mg per kg to 0.4 mg per kg. At 7-9 days post-dose, animals were sacrificed, blood and the liver were collected, and serum TTR and liver editing were measured. Serum TTR and liver editing results are shown in FIG. 22C and FIG. 22D. Negative control mice were dosed with TSS vehicle.

11. Characterization of Codon Schemes

Cas9 sequences using different codon schemes were designed to test for improved protein expression. Each sequence was designed to encode the Cas9 amino acid of SEQ ID No: 3 using a distinct set of codons. In each open reading frame sequence, a single codon was used to encode each amino acid. Sequences vary based on the frequency with which codons occur in complete protein coding genes in *Homo sapiens* based on the NCBI-GenBank Flat File Release 160.0 (Nakamura et al. (2000) *Nucl. Acids Res.* 28, 292; Benson et al. (2006) *Nucleic Acids Res.* 34(Database issue), D16-20) and the abundance of a particular nucleotide among the codons. Based on the codon schemes shown in Table 4, seven different open reading frames for Cas9 (SEQ ID No: 52, 54, and 108-112) were constructed that encode Cas9 protein of SEQ ID NO: 3. These were incorporated into constructs also containing the HS) 5' UTR (SEQ ID NO: 41), an albumin 3' UTR, a T7 promoter and a polyA tail. An exemplary sequence containing the albumin 3' UTR and polyA tail is SEQ ID NO: 53, in which the 3' UTR and polyA tail follow the HSD 5' UTR and the ORF of SEQ ID NO: 52. Also included in these evaluations was a similarly composed construct using a codon scheme based on the optimal codons for improved mRNA half-life as described by Presnyak and colleagues (2015) (SEQ ID No: 107, using the long half life codon set of Table 4) to encode Cas9 protein of SEQ ID NO: 3.

Messenger RNA was produced for each construct by IVT using 100% N1-methyl pseudouridine in place of uridine. HepG2 cells were transfected with 800 ng of each Cas9 mRNA using Lipofectamine™ MessengerMAX™ Transfection Reagent (ThermoFisher). Six hours post transfection, cells were lysed by freeze thaw and cleared by centrifugation. Cas9 protein levels were determined by ELISA assay. Briefly, total protein concentration was determined by bicinchoninic acid assay. An MSD GOLD 96-well Streptavidin SECTOR Plate (Meso Scale Diagnostics, Cat. L15SA-1) was prepared according to manufacturer's protocol using Cas9 mouse antibody (Origene, Cat. CF811179) as the capture antibody and Cas9 (7A9-3A3) Mouse mAb (Cell Signaling Technology, Cat. 14697) as the detection antibody. Recombinant Cas9 protein was used as a calibration standard in Diluent 39 (Meso Scale Diagnostics) with 1×Halt™ Protease Inhibitor Cocktail, EDTA-Free (ThermoFisher, Cat. 78437). ELISA plates were read using the Meso Quickplex SQ120 instrument (Meso Scale Discovery) and data was analyzed with Discovery Workbench 4.0 software package (Meso Scale Discovery).

Figure 23:
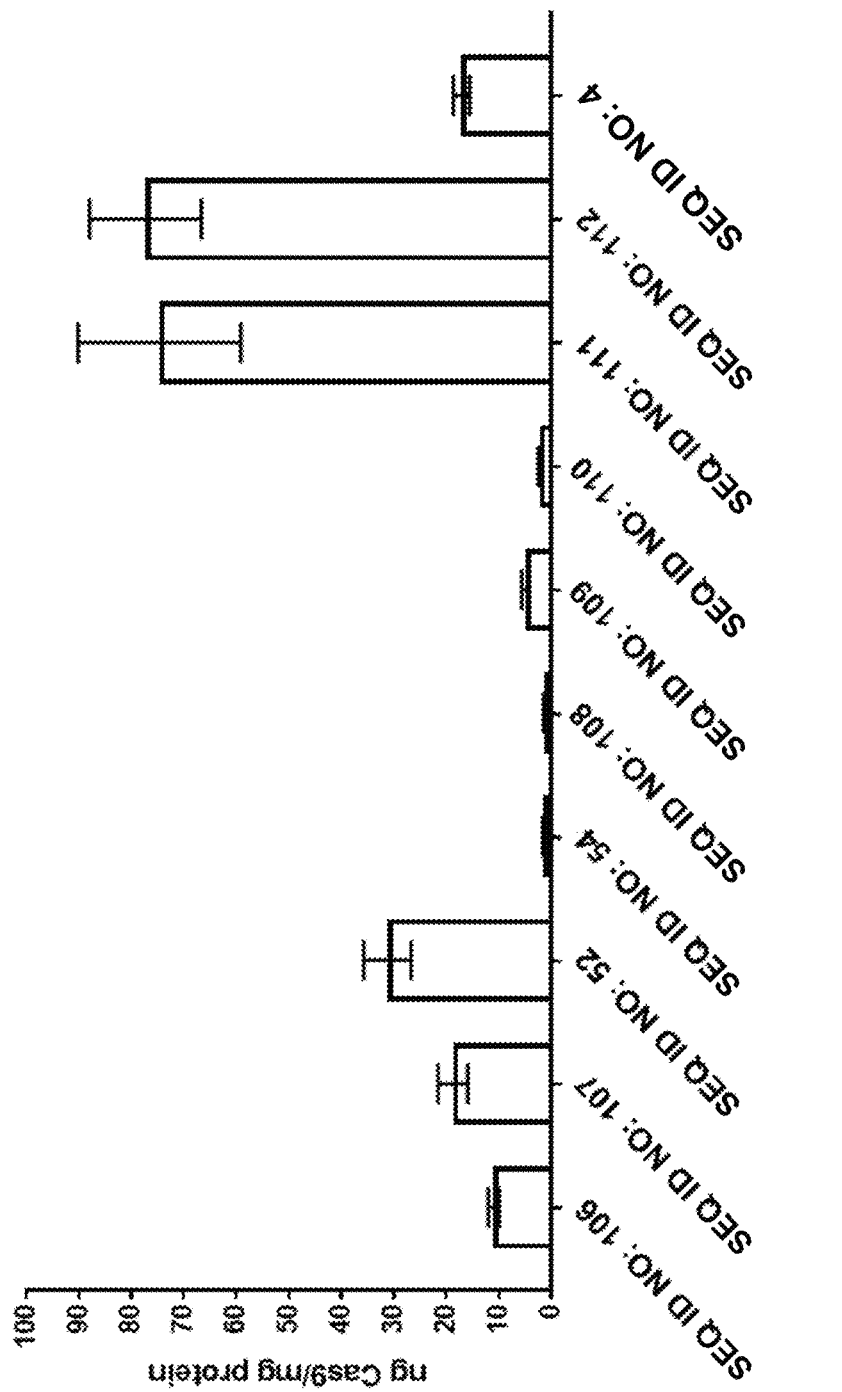
FIG. 23 shows Cas9 protein expression in Hep2G cells after treatment with Cas9 mRNA in which the ORFs had the sequence of the indicated SEQ ID NO.
Figure 24:
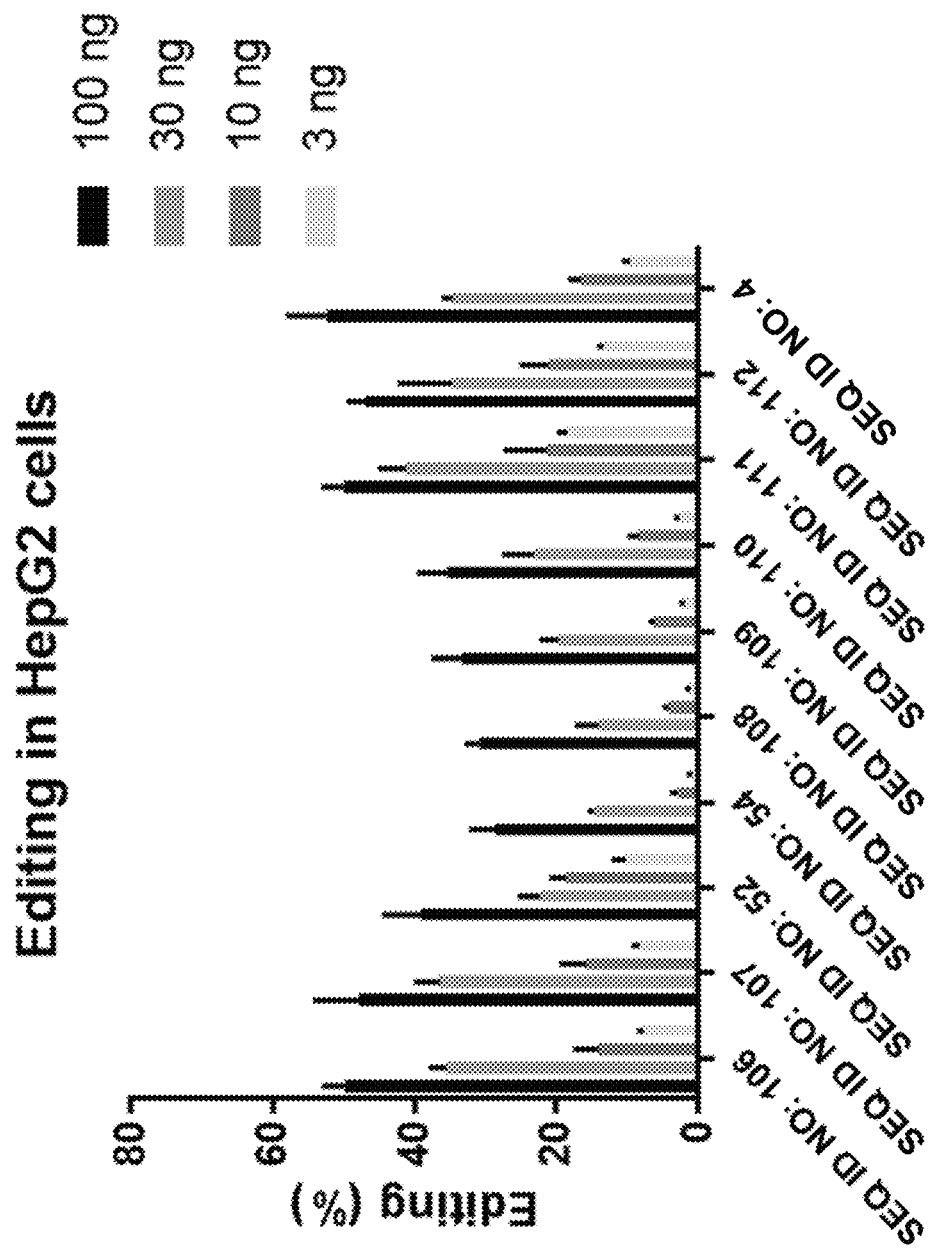
FIG. 24 shows the percentage of editing in HepG2 cells after treatment with Cas9 mRNA in which the ORFs had the sequence of the indicated SEQ ID NO at the indicated concentrations.

Editing efficiency was assessed in vitro by transfecting mRNA together with a guide (G502; SEQ ID NO: 70) targeting transthyretin (TTR) into HepG2 cells and measuring percentage editing. Cas9 mRNAs comprising SEQ ID Nos indicated in Table 25 were assessed at concentrations of mRNA from 3 ng-100 ng. Untreated cells did not show measurable editing. FIGS. 23-24 and Table 25 show the effects of the different codon sets on Cas9 protein expression and editing in vitro.

TABLE 25

In vitro editing and expression of ORFs with different codon sets.

| ORF (codon set) | ng Cas9/mg total protein | ng Cas9/mg total protein Standard Deviation | % Editing (30 ng mRNA transfected) | Editing Standard Deviation |
|---|---|---|---|---|
| SEQ ID No: 50 (Table 6 minimal uridine codons, splice junctions removed) | 10.99 | 1.04 | 35.6 | 2.11 |
| SEQ ID No: 107 (Table 4 long half life) | 18.78 | 2.83 | 36.5 | 3.27 |
| SEQ ID No: 52 (Table 4 low U 1) | 31.23 | 4.47 | 22.2 | 2.83 |
| SEQ ID No: 54 (Table 4 low U 2) | 1.54 | 0.16 | 14.7 | 0.40 |
| SEQ ID No: 108 (Table 4 high U) | 1.41 | 0.12 | 14.0 | 2.95 |
| SEQ ID No: 109 (Table 4 low G) | 4.95 | 0.70 | 19.6 | 2.29 |
| SEQ ID No: 110 (Table 4 low C) | 2.26 | 0.16 | 23.1 | 4.07 |
| SEQ ID No: 111 (Table 4 low A) | 74.62 | 15.53 | 41.3 | 3.56 |
| SEQ ID No: 112 (Table 4 low A/U) | 77.32 | 10.60 | 34.8 | 7.32 |
| SEQ ID No: 4 (Table 6 minimal uridine codons) | 17.16 | 1.54 | 34.7 | 1.15 |

Figure 25:
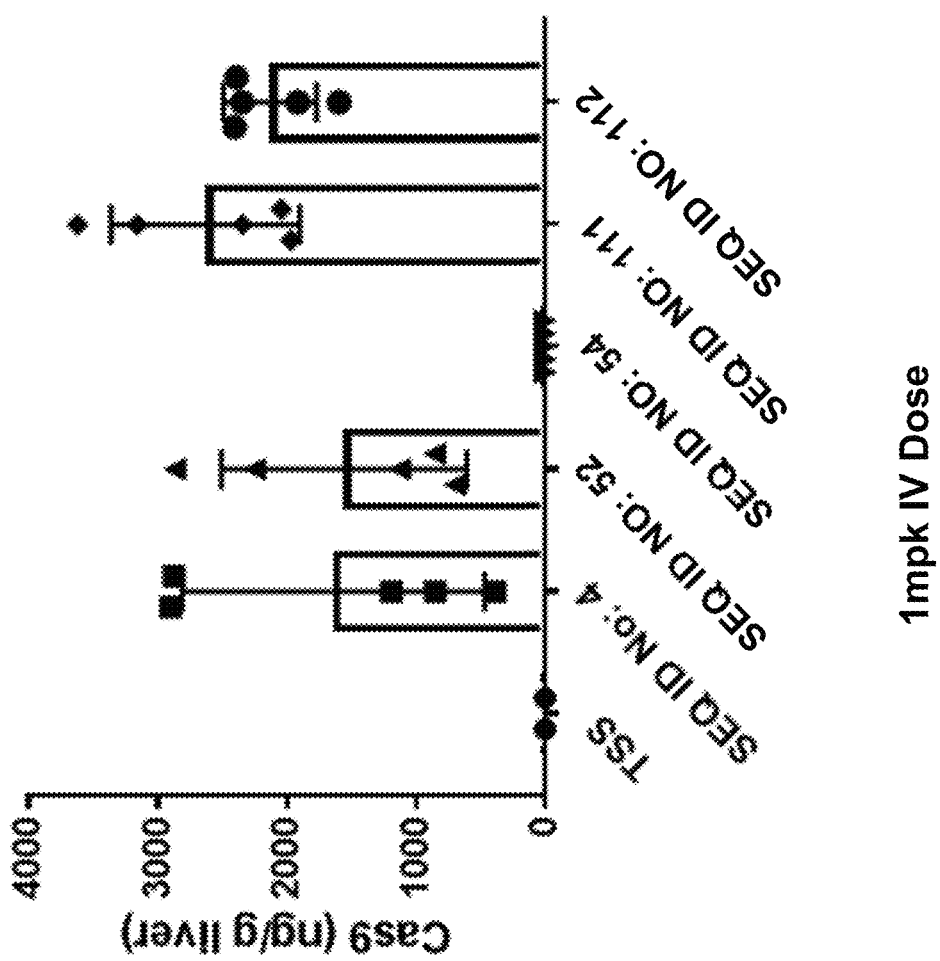
FIG. 25 shows Cas9 expression in liver following dosing of LNP formulations with Cas9 mRNA in which the ORFs had the sequence of the indicated SEQ ID NO.

To determine the effectiveness of the codon schemes in vivo, Cas9 protein expression was measured when expressed in vivo from mRNAs encoding Cas9 using codon schemes described in Table 4. Messenger RNAs as indicated in Table 26 were formulated as LNPs with a guide RNA targeting TTR (G282; SEQ ID NO: 42). The LNPs were assembled using the cross flow procedure and contained 50% Lipid A, 9% DSPC, 38% cholesterol, and 3% PEG2k-DMG in a 50:38:9:3 molar ratio, respectively, and had a N:P ratio of 6.0. LNPs were purified using Amicon PD-10 filters (GE Healthcare) and used at a concentration of 0.32 mg/ml (LNP concentration). CD-1 female mice (n=5 per group) were dosed i.v. at 1 mpk. At 3 hours post-dose, animals were sacrificed, the liver was collected and Cas9 expression in liver were measured. Cas9 protein expression was measured in the liver using the Meso Scale Discovery ELISA assay described above. Approximately 40-50 mg liver tissue was homogenized by bead mill in RIPA Buffer (Boston Bioproducts BP-115) with 1×Complete Protease Inhibitor Tablet (Roche, Cat. 11836170001). FIG. 25 and TABLE 26 show Cas9 expression results in liver. mRNAs for the low A and low A/U codon schemes (ORFs of SEQ ID NOs: 111 and 112) showed the highest Cas9 expression of the tested ORFs. Cas9 protein expression of the negative control and the ORF of SEQ ID NO: 54 were below the lower limit of quantitation (LLOQ).

TABLE 26

| ORF | Average Cas9 (ng/g liver) | Standard Deviation |
|---|---|---|
| TSS | <LLOQ | 0.0 |
| SEQ ID No: 4 | 1644 | 1172 |
| SEQ ID NO: 52 | 1562 | 951 |
| SEQ ID NO: 54 | <LLOQ | 0.0 |
| SEQ ID NO: 111 | 2630 | 730 |
| SEQ ID NO: 112 | 2134 | 362 |

Figure 26:
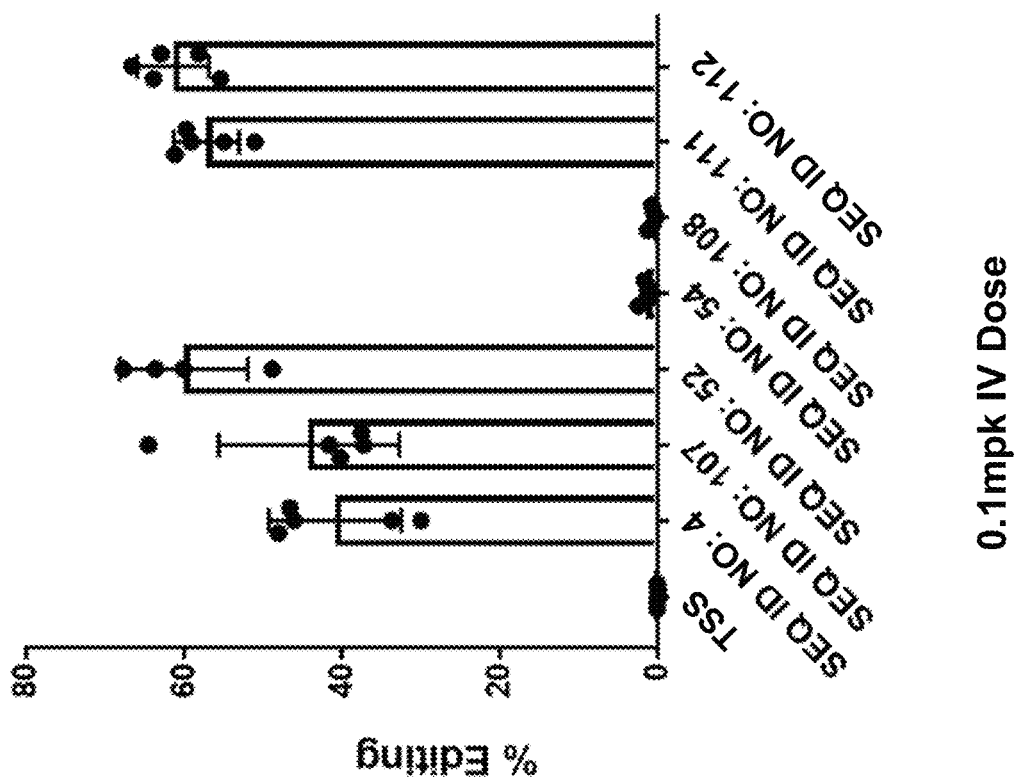
FIG. 26 shows in vivo editing results at the TTR locus following dosing of LNP formulations with Cas9 mRNA in which the ORFs had the sequence of the indicated SEQ ID NO.
Figure 27B:
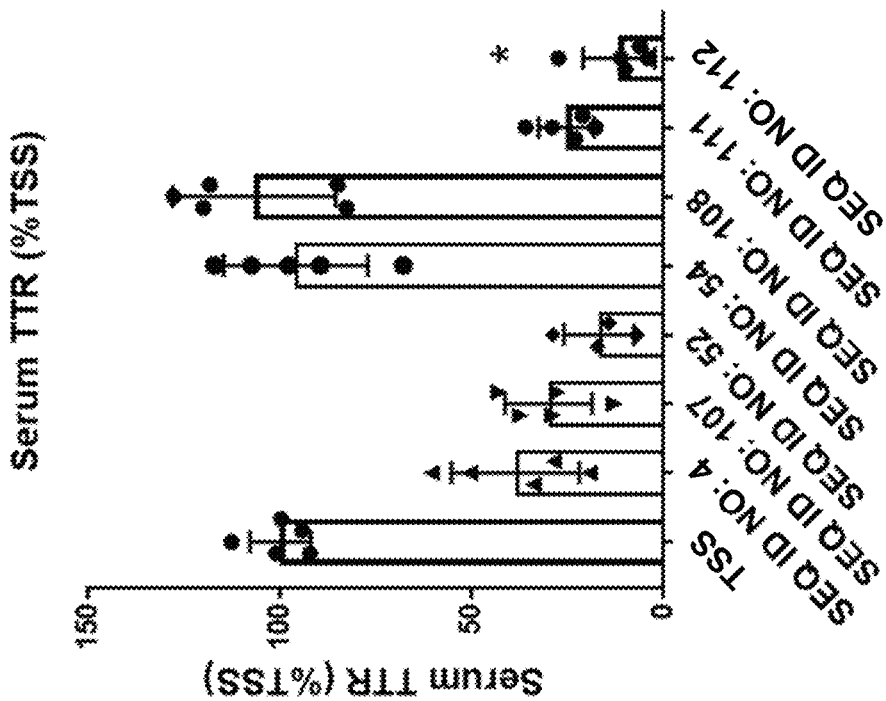
FIGS. 27A-B show serum TTR (A) and serum TTR (% TSS) (B) following dosing of LNP formulations with Cas9 mRNA in which the ORFs had the sequence of the indicated SEQ ID NO.
Figure 27A:
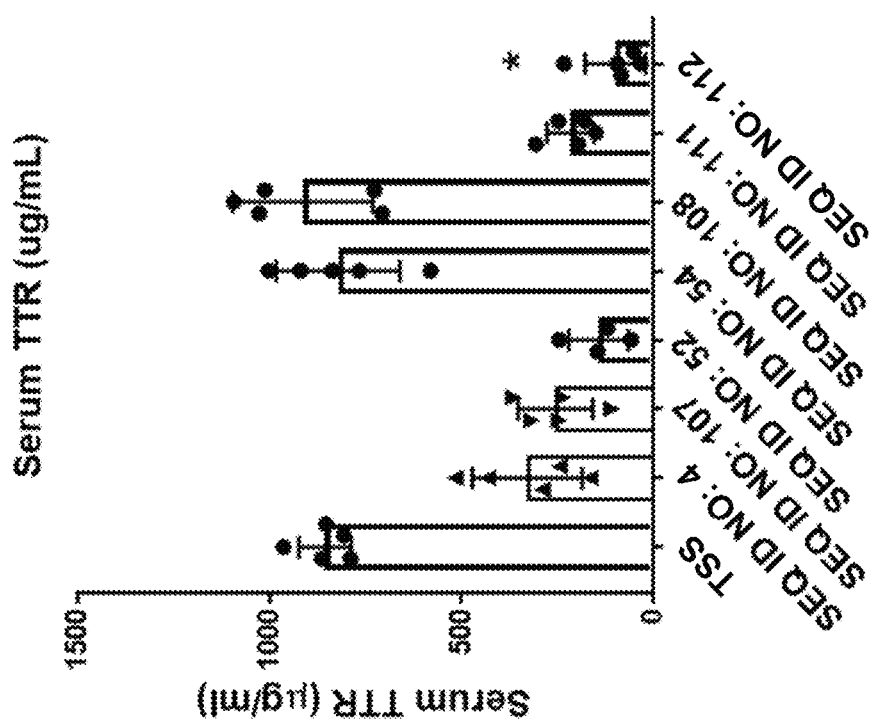

To determine the effectiveness of the codon schemes in vivo, genome editing was measured in vivo from mRNAs encoding Cas9 using different codon schemes. Messenger RNAs as indicated in Table 27 were formulated as LNPs with a guide RNA targeting TTR (G282; SEQ ID NO 42). The LNPs were assembled using the cross flow procedure and contained 50% Lipid A, 9% DSPC, 38% cholesterol, and 3% PEG2k-DMG in a 50:38:9:3 molar ratio, respectively, and had a N:P ratio of 6.0. LNPs were purified using Amicon PD-10 filters (GE Healthcare), and used at a concentration of 0.05 mg/ml (LNP concentration). CD-1 female mice (n=5 per group, except n=4 for the group treated with SEQ ID NO: 52) were dosed i.v. at 0.1 mpk. At 6 days post-dose, animals were sacrificed, blood and the liver were collected, and serum TTR and liver editing were measured. TABLE 27 and FIG. 26 show in vivo editing results. TABLE 27 and FIGS. 27A-B show the serum TTR levels.

TABLE 27

| ORF | Avg % Editing | Editing Standard Deviation | Serum TTR (gg/ml) | Serum TTR Standard Deviation | n |
|---|---|---|---|---|---|
| TSS | 0.06 | 0.05 | 856 | 68 | 5 |
| SEQ ID No: 4 | 40.96 | 8.41 | 329 | 143 | 5 |
| SEQ ID No: 107 | 44.28 | 11.45 | 255 | 97 | 5 |
| SEQ ID No: 52 | 60.10 | 8.07 | 143 | 78 | 4 |
| SEQ ID No: 54 | 1.50 | 0.66 | 822 | 161 | 5 |
| SEQ ID No: 108 | 0.74 | 0.36 | 914 | 182 | 5 |
| SEQ ID No: 111 | 57.26 | 4.15 | 216 | 62 | 5 |
| SEQ ID No: 112 | 61.44 | 4.50 | 100 | 79 | 5 |

Figure 28:
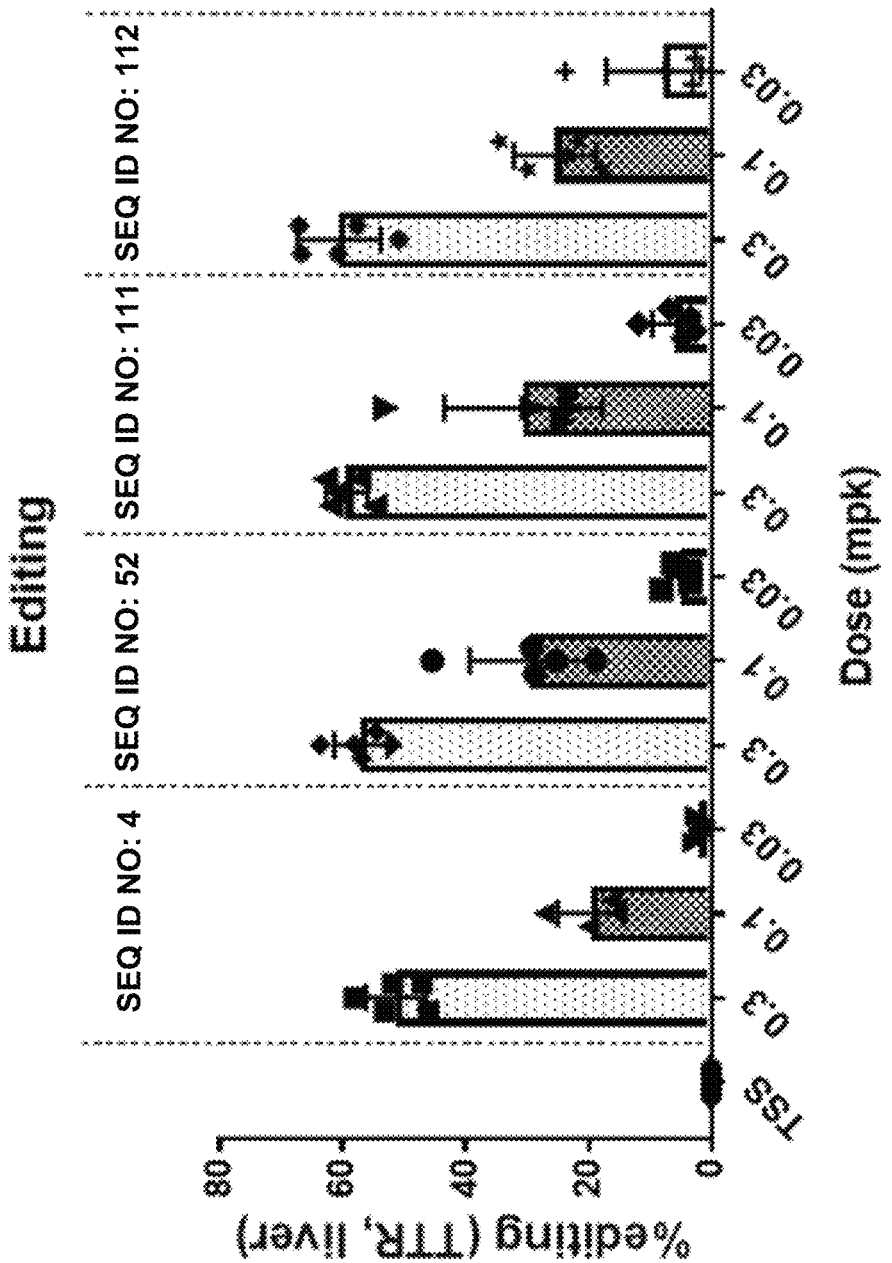
FIG. 28 shows in vivo liver editing following dosing of LNP formulations with Cas9 mRNA in which the ORFs had the sequence of the indicated SEQ ID NO at the indicated amounts.
Figure 29A:
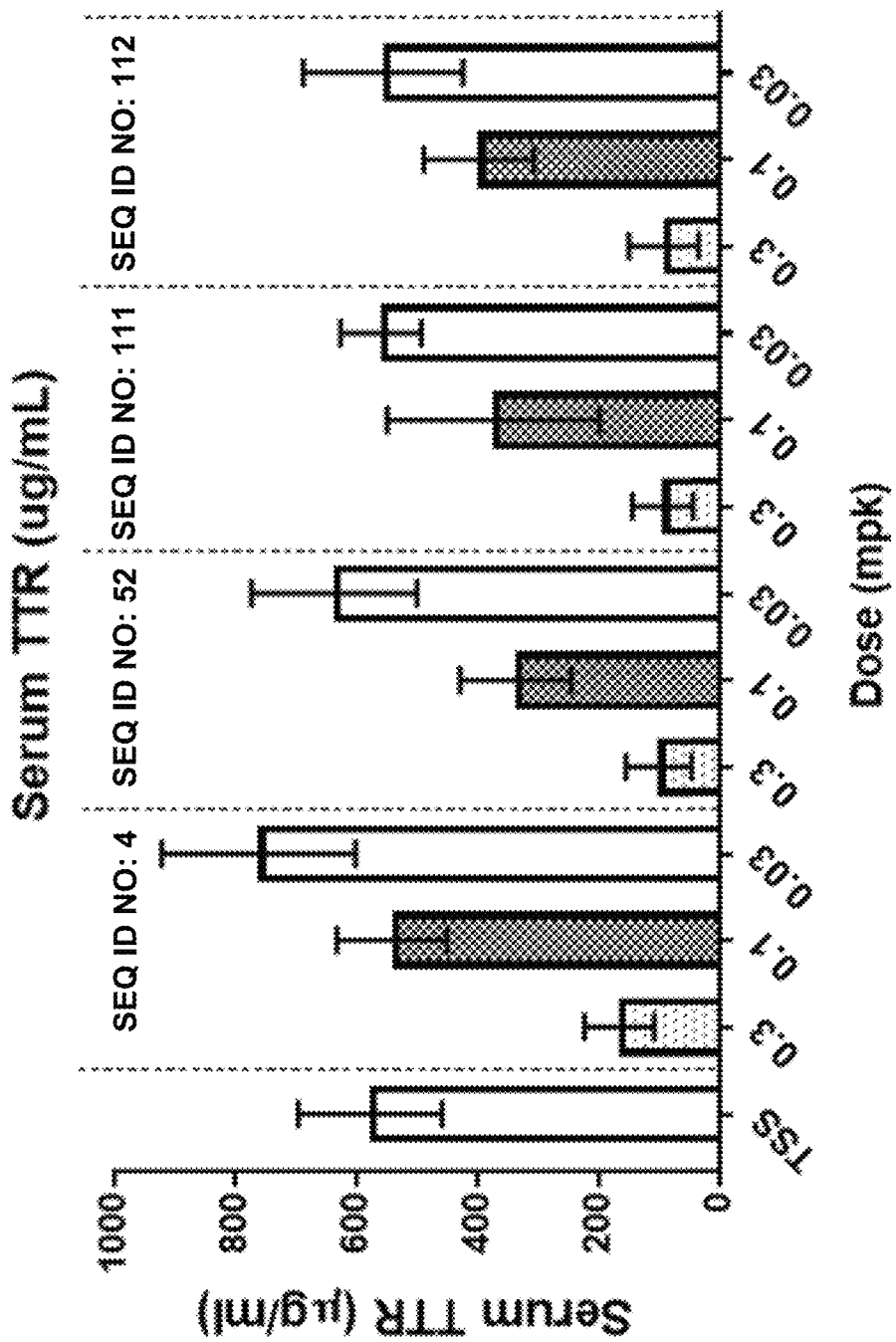
FIGS. 29A-B show serum TTR levels (A) and serum TTR (% TSS) (B) following dosing of LNP formulations with Cas9 mRNA in which the ORFs had the sequence of the indicated SEQ ID NO at the indicated amounts.
Figure 29B:
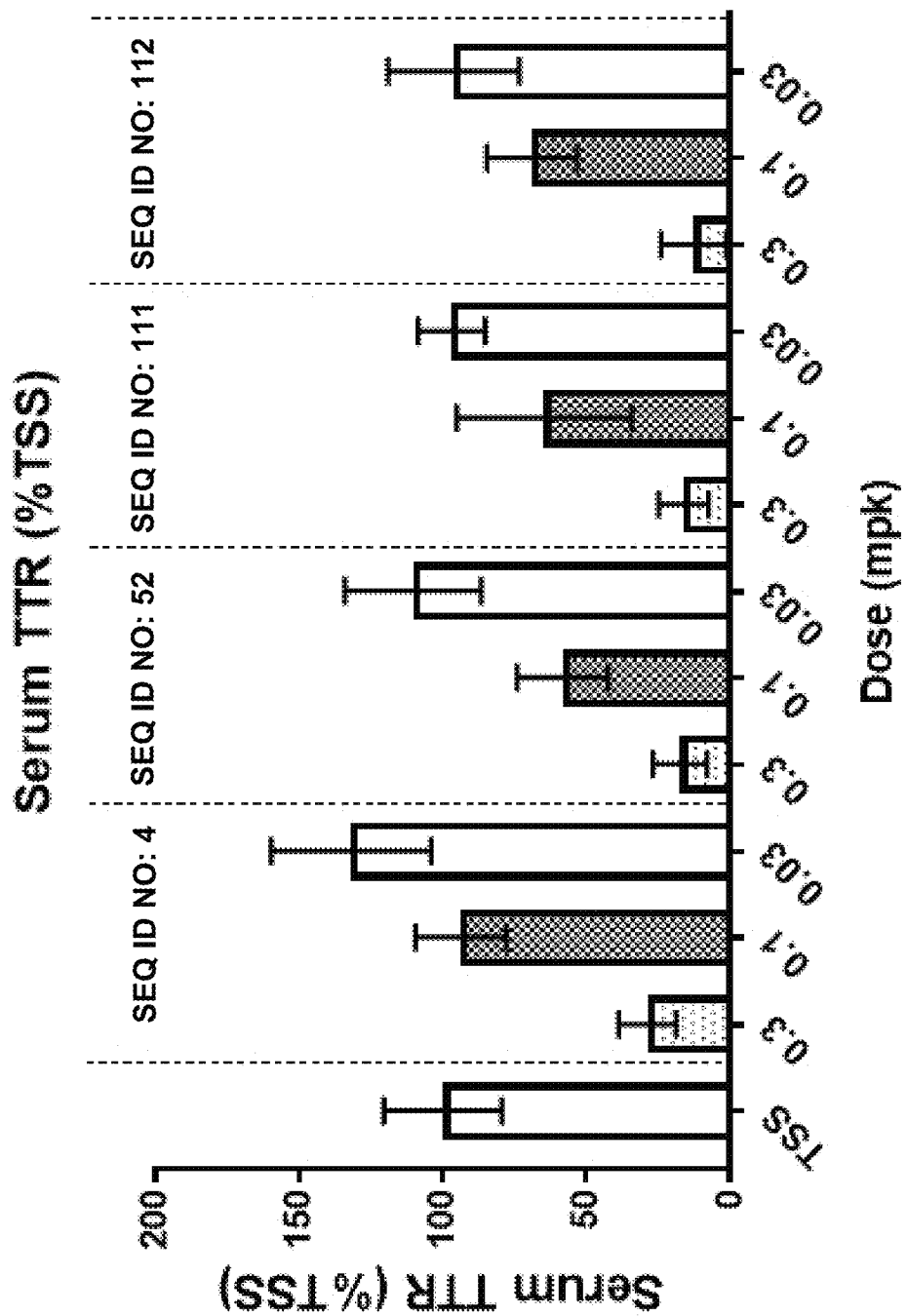

To determine the efficacy of the codon schemes at different mRNA concentrations, an in vivo dose response experiment was performed. Messenger RNAs as indicated in Table 28 were formulated as LNPs with a guide RNA targeting TTR (G282; SEQ ID NO: 42). The LNPs were assembled using the cross flow method and contained 50% Lipid A, 9% DSPC, 38% cholesterol, and 3% PEG2k-DMG. LNPs were purified using Amicon PD-10 filters (GE Healthcare and used at a concentration of 0.7 mg/ml (LNP concentration). CD-1 female mice (n=5 per group) were dosed i.v. at 0.03, 0.1, or 0.3 mpk. At 7 days post-dose, animals were sacrificed, blood and the liver were collected, and serum TTR and liver editing were measured. TABLE 28 and FIG. 28 show in vivo editing results. TABLE 28 and FIGS. 29A-B show the serum TTR levels.

TABLE 28

| ORF | Dose (mpk) | Liver editing (%) | Serum TTR (ug/mL) | Serum TTR (% KD) |
|---|---|---|---|---|
| TSS | n/a | 0.1 | 576.8 | 0.0 |
| SEQ ID No: 4 | 0.3 | 51.3 | 165.6 | 71.3 |
|  | 0.1 | 17.3 | 540.7 | 6.3 |
|  | 0.03 | 1.9 | 761.4 | −32.0 |
| SEQ ID No: 52 | 0.3 | 57.0 | 100.8 | 82.5 |
|  | 0.1 | 29.6 | 336.1 | 41.7 |
|  | 0.03 | 5.0 | 636.4 | −10.3 |
| SEQ ID NO: 111 | 0.3 | 59.4 | 93.8 | 83.7 |
|  | 0.1 | 30.6 | 373.5 | 35.2 |
|  | 0.03 | 5.9 | 559.6 | 3.0 |
| SEQ ID NO: 112 | 0.3 | 60.6 | 92.0 | 87.2 |
|  | 0.1 | 25.5 | 397.5 | 31.1 |
|  | 0.03 | 7.8 | 555.3 | 3.7 |

Figure 30A:
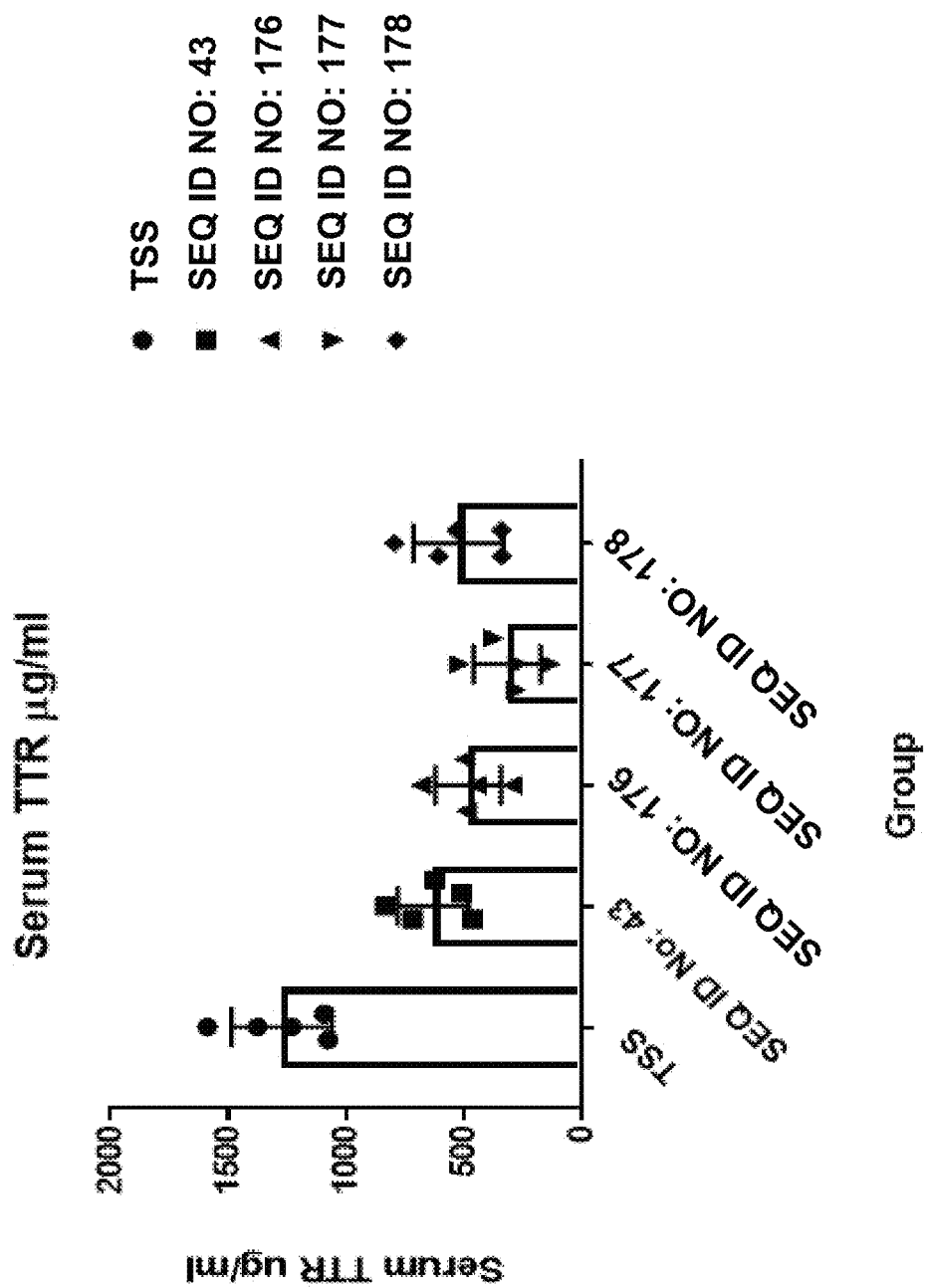
FIGS. 30A-B show serum TTR levels (A) and % editing in the liver (B) following dosing of LNP formulations with Cas9 mRNA in which the transcripts had the sequence of the indicated SEQ ID NO.
Figure 30B:
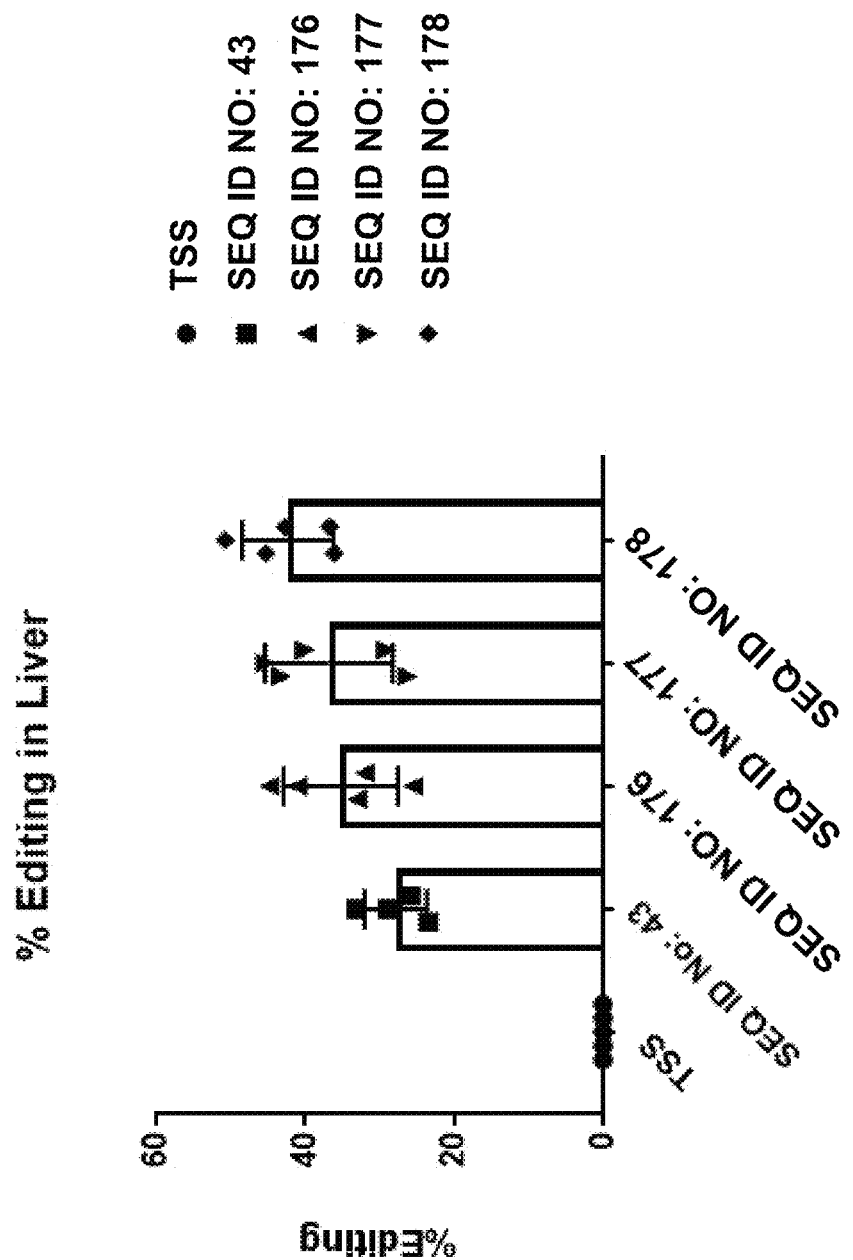

To determine the effectiveness of the codon schemes with different UTRs, genome editing was measured in vivo following administration of mRNAs encoding Cas9. Messenger RNAs as indicated in Table 29 were formulated as LNPs with a guide RNA targeting TTR (G282; SEQ ID NO: 42). The LNPs were assembled using the cross flow procedure and contained 50% Lipid A, 9% DSPC, 38% cholesterol, and 3% PEG2k-DMG in a 50:38:9:3 molar ratio, respectively, and had a N:P ratio of 6.0. LNPs were purified using Amicon PD-10 filters (GE Healthcare) and used at a concentration of 0.05 mg/ml (LNP concentration). CD-1 female mice (n=5 per group; n=4 for SEQ ID No: 43 editing) were dosed i.v. at 0.1 mpk. At 6 days post-dose, animals were sacrificed, blood and the liver were collected, and serum TTR and liver editing were measured. TABLE 29 and FIGS. 30A-B show in vivo editing (B) and serum TTR results (A).

TABLE 29

| mRNA construct | % Editing | Standard Deviation | Serum TTR (gg/ml) | Standard Deviation |
|---|---|---|---|---|
| TSS | 0 | 0 | 1274 | 214 |
| SEQ ID No: 43 | 28 | 4 | 630 | 152 |
| SEQ ID No: 176 | 35 | 8 | 482 | 138 |
| SEQ ID No: 177 | 37 | 9 | 316 | 143 |
| SEQ ID No: 178 | 42 | 6 | 524 | 192 |

12. Characterization of Effects of Capping Structures mRNAs encoding Cas9 and containing caps, UTRs, and polyA tails as indicated in Table 30 were formulated as LNPs with a guide RNA targeting TTR (G282; SEQ ID NO: 42). The LNPs were assembled using the cross flow procedure, contained 50% Lipid A, 9% DSPC, 38% cholesterol, and 3% PEG2k-DMG in a 50:38:9:3 molar ratio, respectively, and had a N:P ratio of 6.0. LNPs were purified using Amicon PD-10 filters (GE Healthcare), and used at a concentration of 0.06 mg/ml (LNP concentration). CD-1 female mice (n=5 per group) were dosed i.v. at 0.1 or 0.3 mpk. At 7 days post-dose, animals were sacrificed, blood and the liver were collected, and serum TTR and liver editing were measured.

Figure 31:
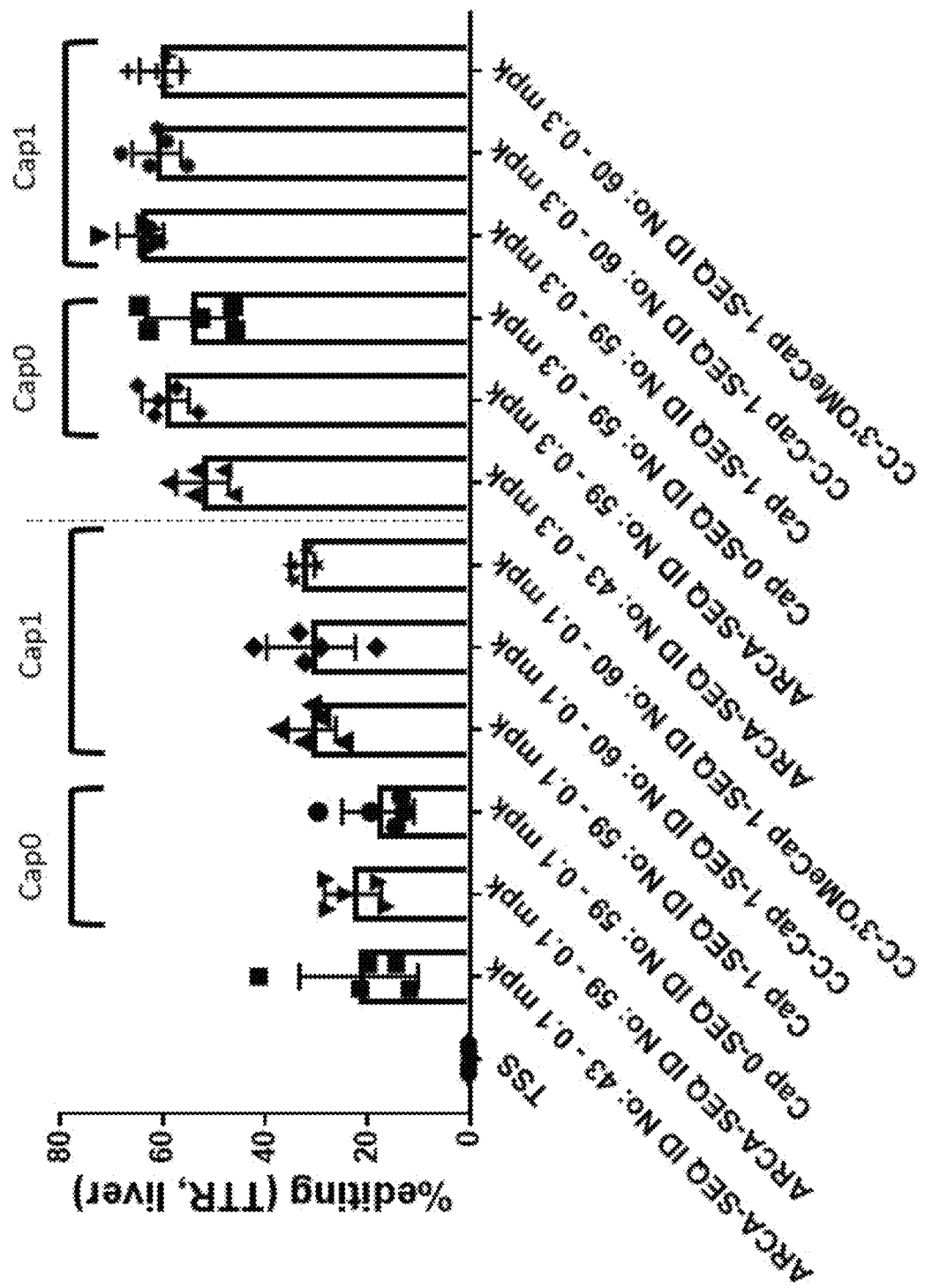
FIG. 31 shows the percentage of TTR editing in the liver following dosing with LNPs formulated with mRNAs having the indicated cap and transcript sequence at the indicated doses.
Figure 32:
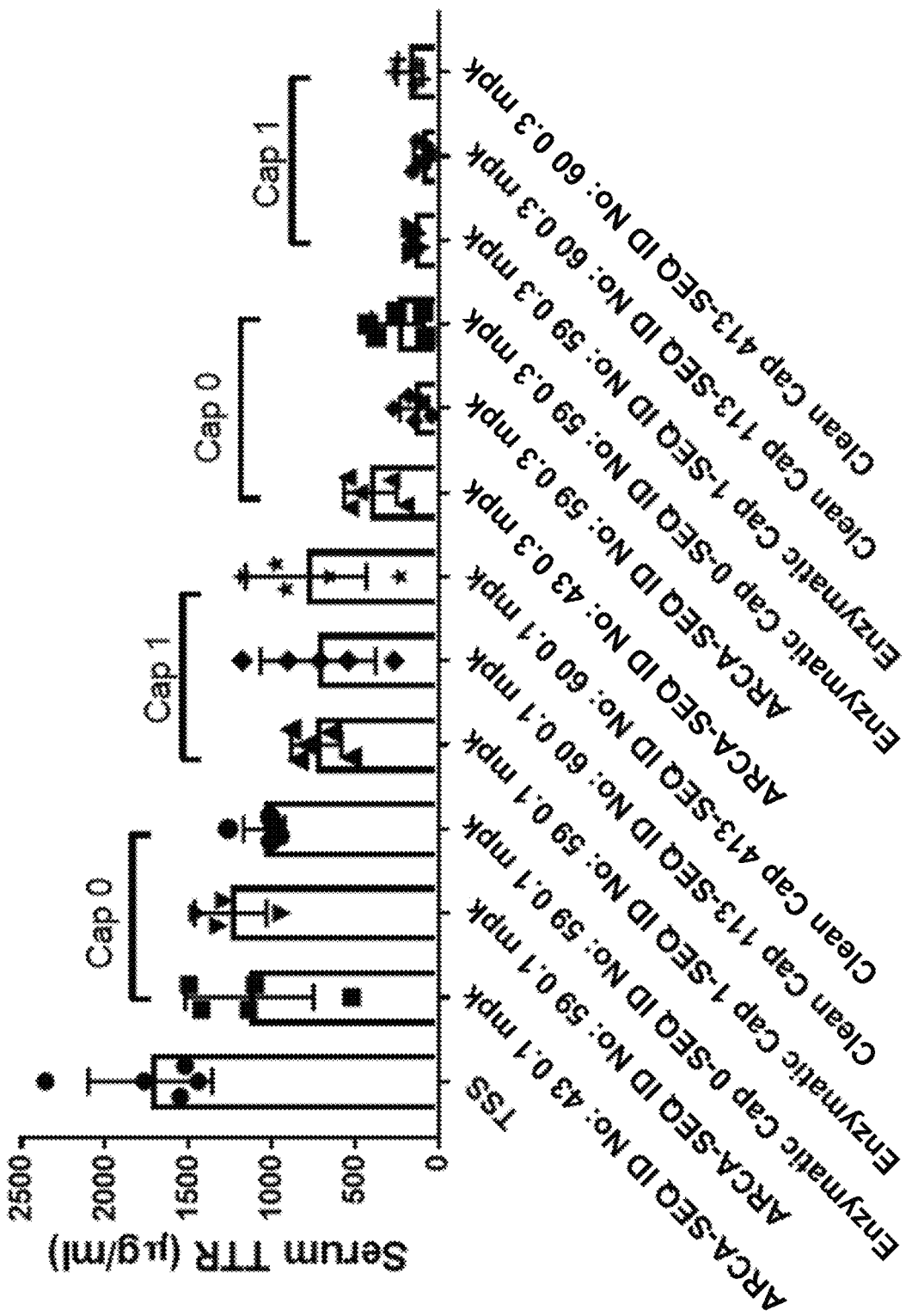
FIG. 32 shows the serum TTR levels following dosing with LNPs formulated with mRNAs having the indicated cap and transcript sequence at the indicated amounts.

FIG. 31 and Table 30 show mRNAs with Cap 1 have ~10% higher average editing than mRNAs with Cap 0 at 0.1 mpk dose. At 0.3 mpk dose, mRNAs with XBG UTR have slightly higher average editing than mRNA with HSD UTR, with the exception of Enzymatic cap 0. Serum TTR results are shown in FIG. 32 (serum TTR results expressed in μg/mL and % of TSS control, respectively); FIG. 31 (liver editing); and Table 30.

TABLE 30

Serum TTR and liver editing results for in vivo capping studies

| mRNA construct | Cap Type | Cap | 5' UTR | Dosage | Average editing (%) | Standard Deviation |
|---|---|---|---|---|---|---|
| SEQ ID No. 43 | Cap 0 | ARCA | HSD | 0.1 mpk | 21.76 | 11.61 |
| SEQ ID No. 59 | Cap 0 | ARCA | XBG | 0.1 mpk | 22.9 | 5.53 |
| SEQ ID No. 59 | Cap 0 | Enzymatic Cap 0 | XBG | 0.1 mpk | 17.98 | 7.04 |
| SEQ ID No. 59 | Cap 1 | Enzymatic Cap 1 | XBG | 0.1 mpk | 31.03 | 6.4 |
| SEQ ID No. 60 | Cap 1 | Clean Cap 113 | XBG | 0.1 mpk | 31.08 | 8.67 |
| SEQ ID No. 60 | Cap 1 | Clean Cap 413 | XBG | 0.1 mpk | 32.78 | 2.05 |
| SEQ ID No. 43 | Cap 0 | ARCA | HSD | 0.3 mpk | 52.28 | 5.14 |
| SEQ ID No. 59 | Cap 0 | ARCA | XBG | 0.3 mpk | 59.56 | 4.57 |
| SEQ ID No. 59 | Cap 0 | Enzymatic Cap 0 | XBG | 0.3 mpk | 54.93 | 10.22 |
| SEQ ID No. 59 | Cap 1 | Enzymatic Cap 1 | XBG | 0.3 mpk | 63.2 | 0.28 |
| SEQ ID No. 60 | Cap 1 | Clean Cap 113 | XBG | 0.3 mpk | 61.28 | 4.76 |
| SEQ ID No. 60 | Cap 1 | Clean Cap 413 | XBG | 0.3 mpk | 60.56 | 3.97 |

13. Characterization of Nuclear Localization Signals

Cas9 sequences using several nuclear localization signals (NLSs) were designed and tested to determine efficacy. Eleven non-canonical NLSs of varying strengths were chosen from those identified by Kosugi et al. (2009) *Journal of Biological Chemistry*, 284(1), 478-485, as shown in Table 31. These amino acid sequences were added to the carboxy-terminus of the Cas9 amino acid sequence (SEQ ID No: 13). The control sequence encodes SEQ ID No. 4.

TABLE 31

Figure 33:
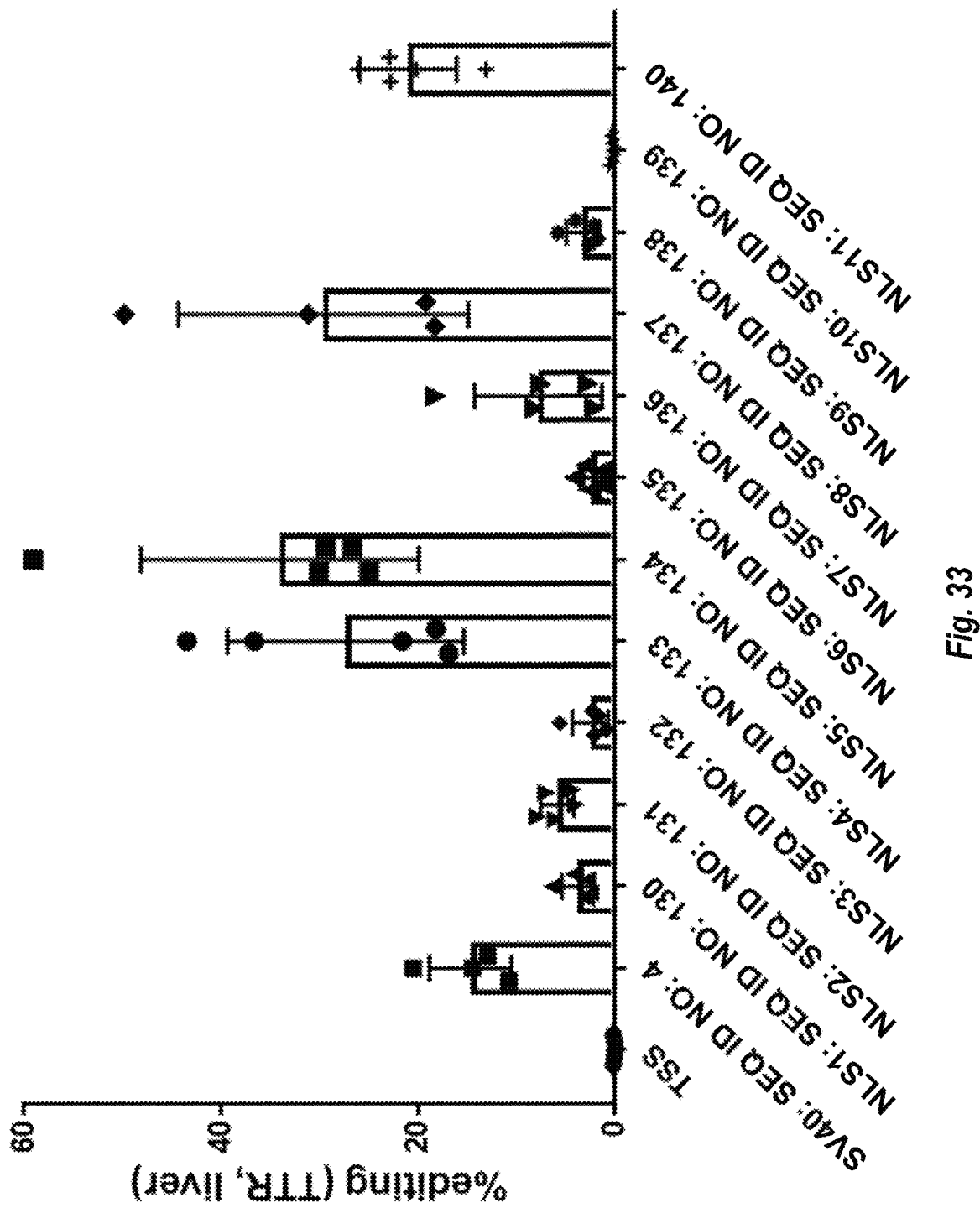
FIG. 33 shows the percentage of TTR editing in the liver following dosing with LNPs formulated with mRNAs encoding Cas9 in which the ORFs had the sequence of the indicated SEQ ID NO, including an NLS as indicated.

| NLS Designation | NLS Amino Acid sequence | NLS Coding Sequence (CDS) | SEQ ID Nos. (NLS amino acid, NLS CDS, ORF CDS) |
|---|---|---|---|
| SV40 | PKKKRKV | CCGAAGAAGAAGAGAAAGGTC | 78, 92, 4 |
| NLS1 | LAAKRSRTT | CTGGCAGCAAAGAGAAGCAGAACAACA | 79, 93, 130 |
| NLS2 | QAAKRSRTT | CAGGCAGCAAAGAGAAGCAGAACAACA | 80, 94, 131 |
| NLS3 | PAPAKRERTT | CCGGCACCGGCAAAGAGAAGAACAACA | 81, 95, 132 |
| NLS4 | QAAKRPRTT | CAGGCAGCAAAGAGACCGAGAACAACA | 82, 96, 133 |
| NLS5 | RAAKRPRTT | AGAGCAGCAAAGAGACCGAGAACAACA | 83, 97, 134 |
| NLS6 | AAAKRSWSMAA | GCAGCAGCAAAGAGAAGCTGGAGCATGGCAGCA | 84, 98, 135 |
| NLS7 | AAAKRVWSMAF | GCAGCAGCAAAGAGAGTCTGGAGCATGGCATTC | 85, 99, 136 |
| NLS8 | AAAKRSWSMAF | GCAGCAGCAAAGAGAAGCTGGAGCATGGCATTC | 86, 100, 137 |
| NLS9 | AAAKRKYFAA | GCAGCAGCAAAGAGAAAGTACTTCGCAGCA | 87, 101, 138 |
| NLS10 | RAAKRKAFAA | AGAGCAGCAAAGAGAAAGGCATTCGCAGCA | 88, 102, 139 |
| NLS11 | RAAKRKYFAV | AGAGCAGCAAAGAGAAAGTACTTCGCAGTC | 89, 103, 140 | mRNAs encoding Cas9 with NLSs as indicated in Table 31 were formulated as LNPs with a guide RNA targeting TTR (G282; SEQ ID NO: 42). The LNPs were assembled using the cross flow procedure and contained 50% Lipid A, 9% DSPC, 38% cholesterol, and 3% PEG2k-DMG in a 50:38:9:3 molar ratio, respectively, and had a N:P ratio of 6.0. LNPs were purified using Amicon PD-10 filters (GE Healthcare), and used at a concentration of about 0.07 mg/ml (LNP concentration). CD-1 female mice (n=5 per group) were dosed i.v. at 0.1 mpk. At 7 days post-dose, animals were sacrificed, blood and the liver were collected, and serum TTR and liver editing were measured. Results are shown in Table 32 and FIG. 33. See Table 31 for SEQ ID NOs corresponding to the NLSs listed in Table 32.

TABLE 32

Liver editing with different nuclear localization signals

| NLS | NLS Class | NLS Strength | 0.1 MPK % Editing | STDEV |
|---|---|---|---|---|
| SV40 | n/a | n/a | 14.67 | 4.17 |
| NLS1 | 2 | 3 | 3.76 | 1.61 |
| NLS2 | 2 | 4 | 5.86 | 1.69 |
| NLS3 | 2 | 5 | 2.50 | 1.82 |
| NLS4 | 2 | 6 | 27.38 | 11.98 |
| NLS5 | 2 | 9 | 27.80 | 2.37 |
| NLS6 | 3 | 1 | 2.20 | 0.82 |
| NLS7 | 3 | 6 | 7.90 | 0.42 |
| NLS8 | 3 | 10 | 25.52 | 15.75 |
| NLS9 | 4 | 2 | 3.26 | 1.65 |

TABLE 32-continued

Liver editing with different nuclear localization signals

| NLS | NLS Class | NLS Strength | 0.1 MPK % Editing | STDEV |
|---|---|---|---|---|
| NLS10 | 4 | 5 | 0.23 | 0.04 |
| NLS11 | 4 | 8 | 21.02 | 4.9 |

Figure 34A:
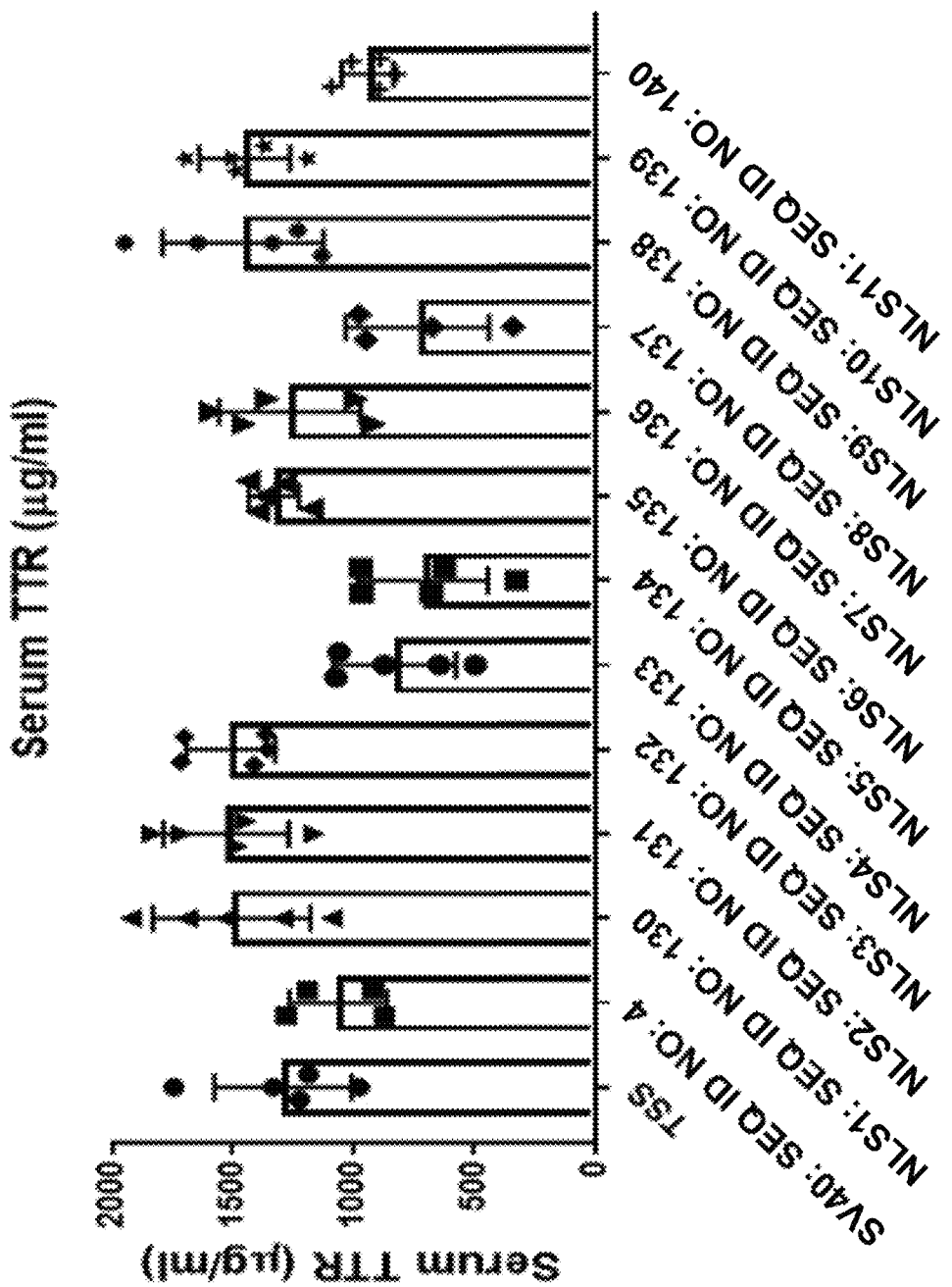
FIGS. 34A-B show serum TTR levels (A) and serum TTR (% TSS) (B) following dosing with LNPs formulated with mRNAs encoding Cas9 in which the ORFs had the sequence of the indicated SEQ ID NO, including an NLS as indicated.
Figure 34B:
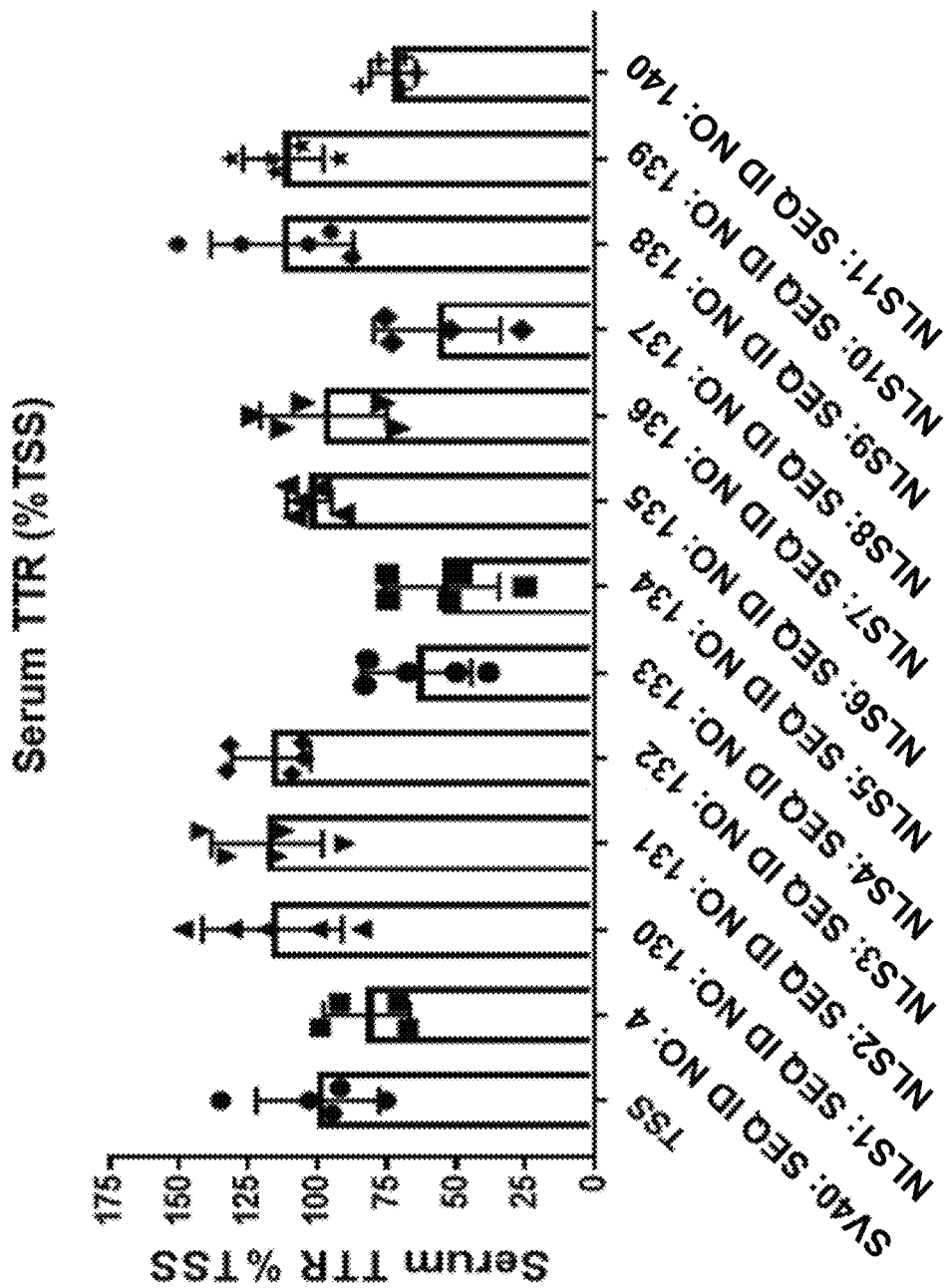
Figure 35:
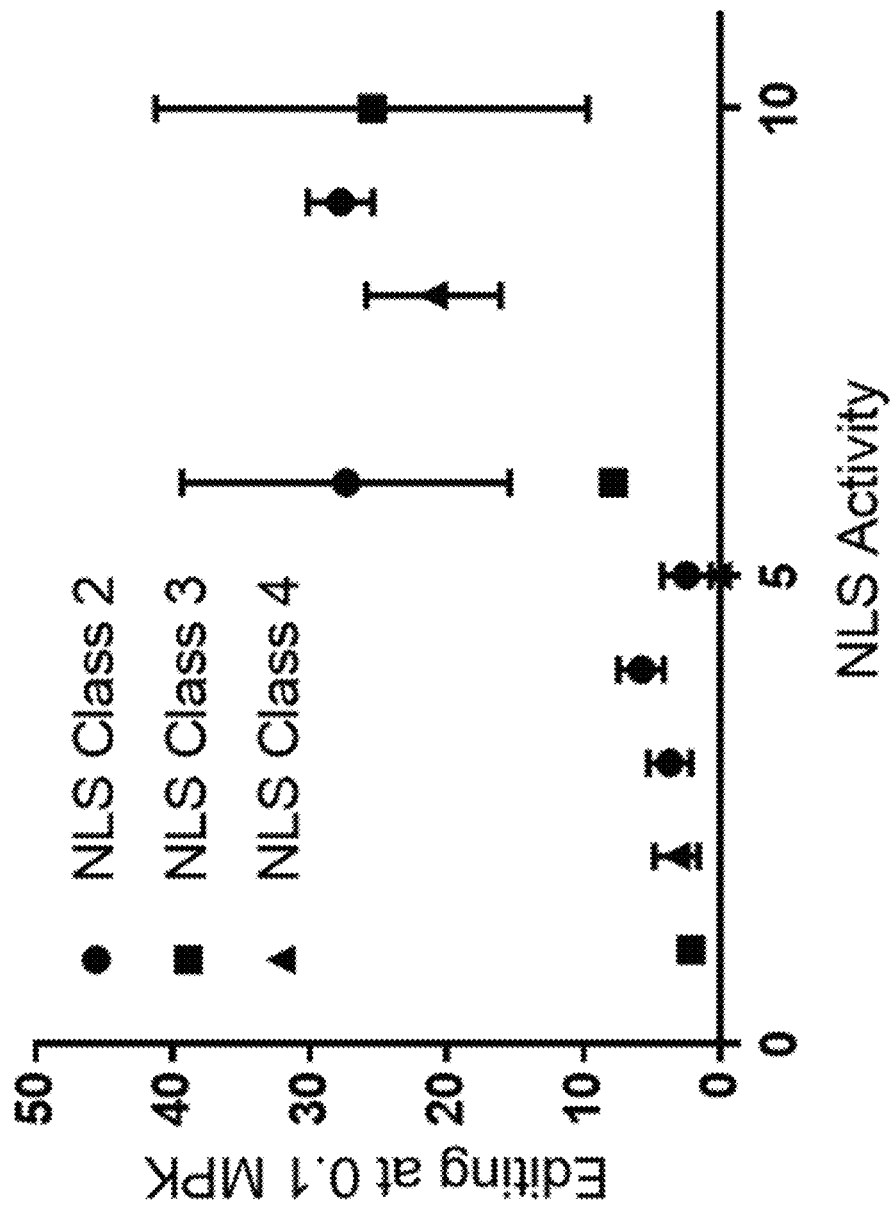
FIG. 35 shows the correlation of NLS activity and editing efficiency following dosing with LNPs formulated with mRNAs encoding Cas9 and including NLS sequences of various classes and activity levels.

NLS5 showed a statistically significant increase over the SV40 NLS (one-way ANOVA, p=0.006). NLS4 and NLS8 each exhibited a possible trend toward increased editing compared to the SV40 NLS, but the difference in this experiment was not statistically significant. FIGS. 34A-B show serum TTR levels following administration of nuclear localization signal variants. Kosugi et al. (2009), supra, rate activity of NLSs ("NLS Strength" in Table 32) for degree of nuclear localization, with a 10 as exclusively nuclear and a 1 as diffuse throughout the cell. NLS activity as rated in this paper is positively correlated with editing efficiency, as shown in FIG. 35.

14. Characterization of Effects of UTRs In Vitro

Figure 36:
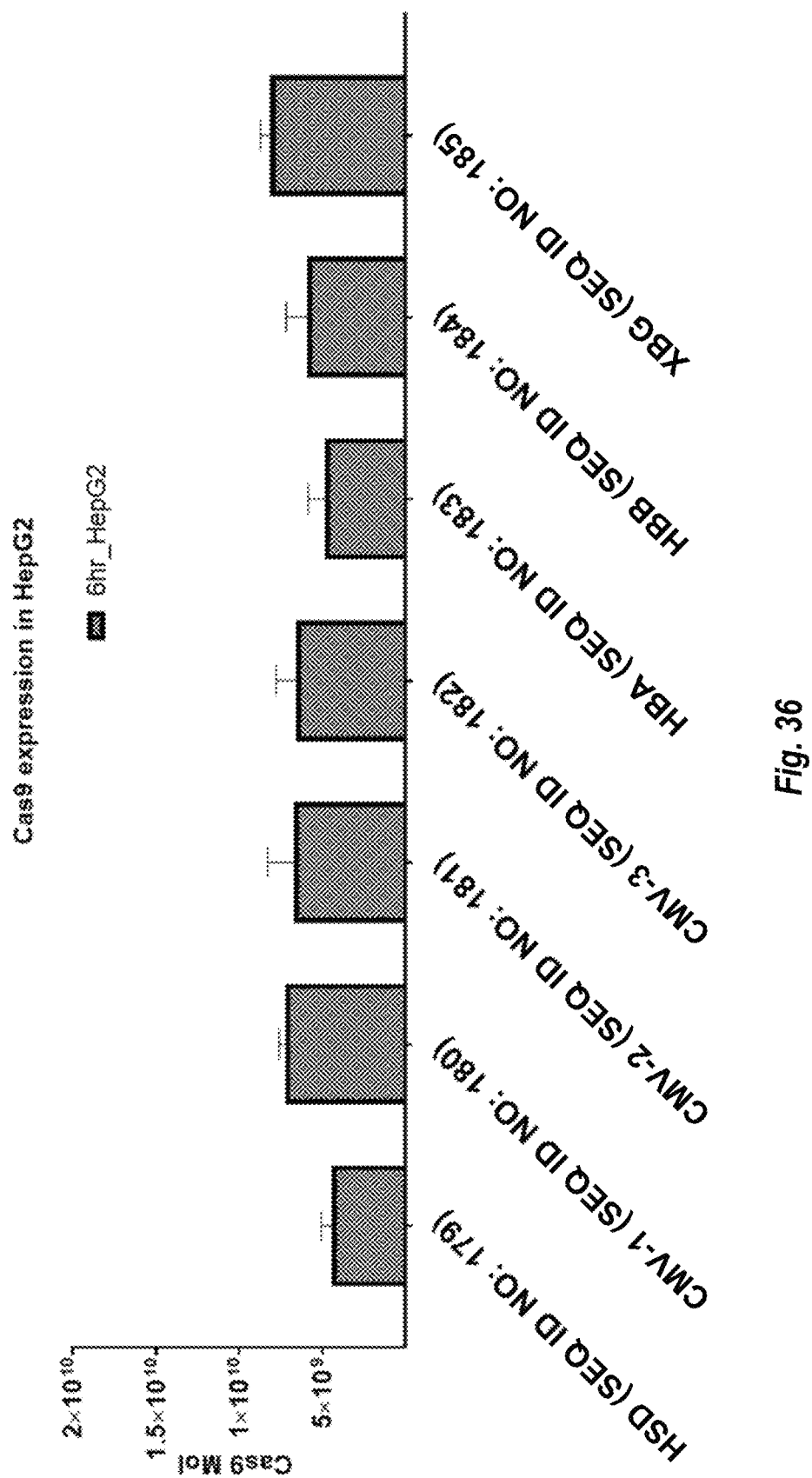
FIG. 36 shows the levels of Cas9 protein expression in HepG2 cells from mRNA transcripts having the indicated sequences and 5' UTRs as indicated.

Table 33 and FIG. 36 show Cas9 expression from transcripts with different 5' UTRs. All constructs used 3' human albumin UTR. Messenger RNA was produced for each construct by IVT. Messenger RNA for SEQ ID No: 179 was produced using linearized plasmid, and all others were generated using PCR product as template. HepG2 cells were transfected with 100 ng of each Cas9 mRNA and guide (G502; SEQ ID NO: 70) targeting transthyretin (TTR) 25 nM final concentration using Lipofectamine™ Messenger- MAX™ Transfection Reagent (ThermoFisher). Six hours post transfection cells were lysed by Nano-Glo® HiBiT Lytic Assay (Promega). Cas9 protein levels were determined by using Nano-Glo® Nano-Glo HiBiT Extracellular Detection System (Promega, Cat. N2420). Table 33 and FIG. 36 show Cas9 expression from transcripts with different 5′ UTRs.

TABLE 33

Cas9 expression

| mRNA construct SEQ ID NO | 5′ UTR | Molecules Cas9 ($10^7$) | Standard Deviation ($10^7$) |
|---|---|---|---|
| 179 | HSD | 447 | 61 |
| 180 | CMV-1 | 723 | 39 |
| 181 | CMV-2 | 672 | 158 |
| 182 | CMV-3 | 662 | 117 |
| 183 | HBA | 488 | 101 |
| 184 | HBB | 595 | 124 |
| 185 | XBG | 813 | 62 |

15. LNP Delivery to Non-Human Primates

Three studies were conducted with LNP formulations prepared as described above using the X-flow/TFF process. The particular molar amounts and cargos are provided in Tables 34-36. Each formulation containing Cas9 mRNA and guide RNA (gRNA) had a mRNA:gRNA ratio of 1:1 by weight. Doses of LNP (in mg/kg, total RNA content), route of administration and whether animals received pre-treatment of dexamethasone are indicated in the Tables. For animals receiving dexamethasone (Dex) pre-treatment, Dex was administered at 2 mg/kg by IV bolus injection, 1h prior to LNP or vehicle administration.

For blood chemistry analysis, blood was drawn from animals at times as indicated in the Tables for each factor measured. Cytokine induction was measured in pre and post treated NHPs. A minimum of 0.5 mL of whole blood was collected from a peripheral vein of restrained, conscious animals into a 4 ml serum separator tube. Blood was allowed to clot for a minimum of 30 min at room temperature followed by centrifuged at 2000×g for 15 minutes. Serum was aliquoted into 2 polypropylene microtubes of 120 uL each and stored at −60 to −86° C. until analysis. A non-human primate U-Plex Cytokine custom kit from Meso Scale Discovery (MSD) was used for analysis. The following parameters were included in the analysis: INF-g, IL-1b, IL-2, IL-4, IL-6, IL-8, IL-10, IL-12p40, MCP-1 and TNF-a, with focus on IL-6 and MCP-1. Kit reagents and standards were prepared as directed in the manufacturer's protocol. NHP serum was used neat. The plates were run on a MSD Sector Imager 6000 with analysis performed with MSD Discovery work bench software Version 4012.

Complement levels were measured in pre and post treated animals by enzyme Immunoassay. A volume of 0.5 mL of whole blood was collected from a peripheral vein of restrained, conscious animals into a 0.5 mL $k_2$EDTA tube. Blood was centrifuged at 2000×g for 15 minutes. Plasma was aliquoted into 2 polypropylene microtubes of 120 uL each and stored at −60 to −86° C. until analysis. A Quidel MicroVue Complement Plus EIA kit (C3a-Cat #A031) or (Bb-Cat #A027) was used for analysis. Kit reagents and standards were prepared as directed in the manufacturer's protocol. The plates were run on a MSD Sector Imager 6000 at optical density at 450 nm. The results were analyzed using a 4-parameter curve fit.

The data for cytokine induction and complement activation are provided in the Tables below. "BLQ" means below the limit of quantification. Guide RNA SEQ ID NOs are as follows: G502, SEQ ID NO: 70; G506, SEQ ID NO: 197; G509, SEQ ID NO: 71; G510, SEQ ID NO: 198.

TABLE 34

Study 1

| Treatment group | Molar Ratios (Lipid A, Cholesterol, DSPC, and PEG2k-DMG, respectively) | N:P | Cargo | sample size (n) | Route | Dose level, total RNA content (mg/kg) | Dex |
|---|---|---|---|---|---|---|---|
| (1) TSS (vehicle) | n/a | n/a | n/a | 3 | IV - infusion | n/a | no |
| (2) LNP699 G502 | 45/44/9/2 | 4.5 | Cas9 mRNA (SEQ ID NO: 48); G000502 | 3 | IV - infusion | 3 | no |
| (3) LNP688 G506 | 45/44/9/2 | 4.5 | Cas9 mRNA (SEQ ID NO: 48); G000506 | 3 | IV - infusion | 3 | no |
| (4) LNP689 G509 | 45/44/9/2 | 4.5 | Cas9 mRNA (SEQ ID NO: 48); G000509 | 3 | IV - infusion | 3 | no |
| (5) LNP690 G510 | 45/44/9/2 | 4.5 | Cas9 mRNA (SEQ ID NO: 48); G000510 | 3 | IV - infusion | 3 | no |

TABLE 35

Study 2

| Treatment group | Molar Ratios (Lipid A, Cholesterol, DSPC, and PEG2k-DMG, respectively | N:P | Cargo | sample size (n) | Route | Dose level, total RNA content (mg/kg) | Dex |
|---|---|---|---|---|---|---|---|
| (1) TSS (vehicle) | n/a | n/a | | 1 | IV-bolus | n/a | yes |
| (2) TSS (vehicle) | n/a | n/a | | 1 | IV-bolus | n/a | no |
| (3) LNP898 G502 | 45/44/9/2 | 4.5 | Cas9 mRNA (SEQ ID NO: 48); G000502 | 1 | IV - infusion | 3 | yes |
| (4) LNP898 G502 | 45/44/9/2 | 4.5 | Cas9 mRNA (SEQ ID NO: 48); G000502 | 1 | IV - infusion | 3 | no |
| (5) LNP897 G502 | 45/43/9/3 | 4.5 | Cas9 mRNA (SEQ ID NO: 48); G000502 | 1 | IV-bolus | 3 | yes |
| (6) LNP897 G502 | 45/43/9/3 | 4.5 | Cas9 mRNA (SEQ ID NO: 48); G000502 | 1 | IV-bolus | 3 | no |
| (7) LNP897 G502 | 45/43/9/3 | 4.5 | Cas9 mRNA (SEQ ID NO: 48); G000502 | 1 | IV - infusion | 3 | yes |
| (8) LNP897 G502 | 45/43/9/3 | 4.5 | Cas9 mRNA (SEQ ID NO: 48); G000502 | 1 | IV - infusion | 3 | no |
| (9) LNP916 GFP | 45/43/9/3 | 4.5 | eGFP mRNA (SEQ ID NO: 73) | 1 | IV - infusion | 6 | yes |
| (10) LNP916 GFP | 45/43/9/3 | 4.5 | eGFP mRNA (SEQ ID NO: 73 | 1 | IV - infusion | 6 | no |

TABLE 36

Study 3

| Treatment group | Molar Ratios (Lipid A, Cholesterol, DSPC, and PEG2k-DMG, respectively | N:P | Cargo | sample size (n) | Route | Dose level, total RNA content (mg/kg) | Dex |
|---|---|---|---|---|---|---|---|
| (1) TSS | n/a | n/a | n/a | 3 | IV-bolus | n/a | no |
| (2) LNP1021 G502 | 50/38/9/3 | 6 | Cas9 mRNA (SEQ ID NO: 43); G000502 | 3 | IV-bolus | 1 | no |
| (3) LNP1021 G502 | 50/38/9/4 | 6 | Cas9 mRNA (SEQ ID NO: 43); G000502 | 1 | IV-bolus | 1 | yes |
| (4) LNP1022 G502 | 55/33/9/3 | 6 | Cas9 mRNA (SEQ ID NO: 43); G000502 | 3 | IV-bolus | 1 | no |
| (5) LNP1023 G502 | 45/43/9/3 | 4.5 | Cas9 mRNA (SEQ ID NO: 43); G000502 | 3 | IV-bolus | 3 | no |

TABLE 36-continued

Study 3

| Treatment group | Molar Ratios (Lipid A, Cholesterol, DSPC, and PEG2k-DMG, respectively) | N:P | Cargo | sample size (n) | Route | Dose level, total RNA content (mg/kg) | Dex |
|---|---|---|---|---|---|---|---|
| (6) LNP1024 G509 | 50/38/9/3 | 6 | Cas9 mRNA (SEQ ID NO: 43); G000509 | 3 | IV-bolus | 1 | no |
| (7) LNP1024 G509 | 50/38/9/4 | 6 | Cas9 mRNA (SEQ ID NO: 43); G000509 | 1 | IV-bolus | 1 | yes |
| (8) LNP1025 G509 | 55/33/9/3 | 6 | Cas9 mRNA (SEQ ID NO: 43); G000509 | 3 | IV-bolus | 1 | no |
| (9) LNP1021 G502 | 50/38/9/3 | 6 | Cas9 mRNA (SEQ ID NO: 43); G000502 | 1 | IV-bolus | 3 | no |
| (10) LNP1022 G502 | 50/38/9/3 | 6 | Cas9 mRNA (SEQ ID NO: 43); G000502 | 1 | IV-bolus | 3 | no |

TABLE 37

IL-6 measurements from Study 1

| Treatment Group | Pre Bleed | 6 hour | 24 hour |
|---|---|---|---|
| (1) TSS (vehicle) | 5.71 ± 2.70 | 29.1 ± 20.37 | 7.05 ± 3.49 |
| (2) LNP699 G502 | 9.73 ± 8.34 | 1296.41 ± 664.71 | 5.43 ± 7.68 |
| (3) LNP688 G506 | 16.83 ± 4.08 | 1749.47 ± 1727.22 | 38.57 ± 39.39 |
| (4) LNP689 G509 | 18.11 ± 11.51 | 1353.49 ± 766.66 | 32.42 ± 18.40 |
| (5) LNP690 G510 | 13.95 ± 1.85 | 11838 ± 17161.74 | 90.07 ± 96.02 |

TABLE 38

MCP-1 measurements from Study 1

| Treatment Group | Pre Bleed | 6 hour | 24 hour |
|---|---|---|---|
| (1) TSS (vehicle) | 810.49 ± 178.27 | 1351.16 ± 397.31 | 745.25 ± 56.49 |
| (2) LNP699 G502 | 842.31 ± 350.65 | 19298.49 ± 11981.14 | 2092.89 ± 171.21 |
| (3) LNP688 G506 | 1190.79 ± 383.64 | 13500.17 ± 12691.60 | 1414.71 ± 422.43 |
| (4) LNP689 G509 | 838.63 ± 284.42 | 14427.7 ± 8715.48 | 1590 ± 813.23 |
| (5) LNP690 G510 | 785.32 ± 108.97 | 52557.24 ± 48034.68 | 6319.77 ± 983.37 |

TABLE 39

Complement C3a measurements from Study 1

| Treatment Group | Pre Bleed | 6 hour | day 7 |
|---|---|---|---|
| (1) TSS (vehicle) | 23.9 ± 11.95 | 25.51 ± 14.79 | 30.67 ± 18.36 |
| (2) LNP699 G502 | 32.36 ± 11.29 | 94.33 ± 58.45 | 38.50 ± 12.69 |
| (3) LNP688 G506 | 22.30 ± 1.73 | 127.00 ± 22.34 | 37.80 ± 6.86 |
| (4) LNP689 G509 | 35.83 ± 21.94 | 174.00 ± 44.51 | 50.83 ± 21.92 |
| (5) LNP690 G510 | 36.30 ± 8.21 | 163.00 ± 40.60 | 42.50 ± 12.44 |

TABLE 40

Complement bb measurements from Study 1

| Treatment Group | 04-bb | Pre Bleed | 6 hour | day 7 |
|---|---|---|---|---|
| (1) TSS (vehicle) | Control | 1.53 ± 0.19 | 3.37 ± 2.13 | 1.43 ± 0.71 |
| (2) LNP699 G502 | G502 | 1.45 ± 0.39 | 9.01 ± 5.28 | 1.57 ± 0.54 |
| (3) LNP688 G506 | G506 | 1.45 ± 0.78 | 11.78 ± 2.33 | 1.78 ± 0.84 |
| (4) LNP689 G509 | G509 | 1.95 ± 0.99 | 15.73 ± 2.23 | 2.83 ± 0.88 |
| (5) LNP690 G510 | G510 | 2.12 ± 0.44 | 13.57 ± 1.23 | 2.21 ± 0.72 |

TABLE 41

IL-6 measurements from Study 2

| Treatment group | Pre Bleed | 90 min | 6 hour | 24 hour | Day 7 |
|---|---|---|---|---|---|
| (1) TSS (vehicle) | 1.77 | 11.46 | 4.2 | 2.76 | 3.01 |
| (2) TSS (vehicle) | 5.23 | 18.11 | 20.36 | 13.2 | 6.36 |
| (3) LNP898 G502 | 2.02 | 1305.75 | 1138.22 | 383.32 | 16.02 |
| (4) LNP898 G502 | 2.34 | 37.19 | 91.59 | 14.11 | 3.07 |
| (5) LNP897 G502 | 2.1 | 55.79 | 6.89 | 2.26 | 2.01 |
| (6) LNP897 G502 | 6.8 | 10.1 | 44.72 | 5.4 | 2.01 |
| (7) LNP897 G502 | 1.97 | 44.87 | 32.61 | 2.97 | 1.11 |
| (8) LNP897 G502 | 3.14 | 37.68 | 73.41 | 8.58 | 2.22 |
| (9) LNP916 GFP | 1.6 | BLQ | 95.32 | 27.58 | BLQ |
| (10) LNP916 GFP | 2.43 | BLQ | 883.01 | 66.71 | BLQ |

TABLE 42

MCP-1 measurements from Study 2

| Treatment group | Pre Bleed | 90 min | 6 hour | 24 hour | Day 7 |
|---|---|---|---|---|---|
| (1) TSS (vehicle) | 312.12 | 197.24 | 145.36 | 177.02 | 403.82 |
| (2) TSS (vehicle) | 232.44 | 175.08 | 187.72 | 136.64 | 325.69 |
| (3) LNP898 G502 | 249.1 | 2183.5 | 1814.64 | 1887.41 | 372.38 |
| (4) LNP898 G502 | 349.51 | 430.49 | 5635.55 | 953.05 | 236.6 |
| (5) LNP897 G502 | 492.3 | 989.98 | 409.08 | 302.97 | 506.82 |
| (6) LNP897 G502 | 283.79 | 225.1 | 1141.08 | 484.59 | 259.46 |
| (7) LNP897 G502 | 223.16 | 349.79 | 398.57 | 172.67 | 287.09 |
| (8) LNP897 G502 | 584.42 | 853.51 | 3880.81 | 1588.46 | 692.99 |
| (9) LNP916 GFP | 325.84 | BLQ | 1189.97 | 2279.82 | BLQ |
| (10) LNP916 GFP | 175.47 | BLQ | 3284.16 | 2023.53 | BLQ |

TABLE 43

Complement C3a measurements from Study 2

| Treatment group | Pre Bleed | 90 min | 6 hour | 24 hour | Day 7 |
|---|---|---|---|---|---|
| (1) TSS (vehicle) | 0.087 | 0.096 | 0.048 | 0.033 | 0.038 |
| (2) TSS (vehicle) | 0.369 | 0.311 | 0.146 | 0.1 | 0.106 |
| (3) LNP898 G502 | 0.087 | 0.953 | 0.647 | 0.277 | 0.065 |
| (4) LNP898 G502 | 0.099 | 0.262 | 0.123 | 0.049 | 0.044 |
| (5) LNP897 G502 | 0.067 | 0.479 | 0.209 | 0.036 | 0.036 |
| (6) LNP897 G502 | 0.141 | 0.433 | 0.34 | 0.11 | 0.074 |
| (7) LNP897 G502 | 0.1 | 0.345 | 0.396 | 0.096 | 0.127 |
| (8) LNP897 G502 | 0.261 | 0.458 | 0.409 | 0.244 | 0.313 |
| (9) LNP916 GFP | 0.149 | BLQ | 0.714 | 0.382 | BLQ |
| (10) LNP916 GFP | 0.117 | BLQ | 0.752 | 0.723 | BLQ |

TABLE 44

Complement bb measurements from Study 2

| Treatment group | Pre Bleed | 90 min | 6 hour | 24 hour | Day 7 |
|---|---|---|---|---|---|
| (1) TSS (vehicle) | 0.087 | 0.096 | 0.048 | 0.033 | 0.038 |
| (2) TSS (vehicle) | 0.369 | 0.311 | 0.146 | 0.1 | 0.106 |
| (3) LNP898 G502 | 0.087 | 0.953 | 0.647 | 0.277 | 0.065 |
| (4) LNP898 G502 | 0.099 | 0.262 | 0.123 | 0.049 | 0.044 |
| (5) LNP897 G502 | 0.067 | 0.479 | 0.209 | 0.036 | 0.036 |
| (6) LNP897 G502 | 0.141 | 0.433 | 0.34 | 0.11 | 0.074 |
| (7) LNP897 G502 | 0.1 | 0.345 | 0.396 | 0.096 | 0.127 |
| (8) LNP897 G502 | 0.261 | 0.458 | 0.409 | 0.244 | 0.313 |
| (9) LNP916 GFP | 0.149 | BLQ | 0.714 | 0.382 | BLQ |
| (10) LNP916 GFP | 0.117 | BLQ | 0.752 | 0.723 | BLQ |

TABLE 45

IL-6 measurements from Study 3

| Treatment group | Pre-bleed | 90 min | 6 hour | 24 hour | Day 7 |
|---|---|---|---|---|---|
| (1) TSS | 1.89 ± 0.97 | 2.56 ± 1.41 | 0.90 ± 0.71 | BLQ | 0.08 |
| (2) LNP1021 G502 | 210 ± 0.35 | 7.44 ± 5.16 | 6.94 ± 8.45 | 1.07 ± 1.11 | 1.76 ± 0.98 |
| (3) LNP1021 G502 | 0.79 | 2.96 | 4.25 | 0.67 | 0.27 |
| (4) LNP1022 G502 | 1.54 ± 1.32 | 20.42 ± 31.60 | 13.94 ± 10.10 | 0.98 ± 0.41 | 2.04 ± 0.65 |
| (5) LNP1023 G502 | 2.92 ± 1.68 | 6.28 ± 7.18 | 6.06 ± 2.31 | 3.62 ± 4.68 | 2.00 ± 1.21 |
| (6) LNP1024 G509 | 1.43 ± 0.62 | 2.64 ± 1.92 | 7.72 ± 11.96 | 0.45 ± 0.19 | 0.88 ± 0.79 |
| (7) LNP1024 G509 | 1.35 ± 0.74 | 2.64 ± 2.35 | 1.71 ± 0.41 | 0.36 ± 0.58 | 0.51 ± 0.32 |
| (8) LNP1025 G509 | 1.64 | 2.68 | 25.65 | 0.58 | 2.00 |
| (9) LNP1021 G502 | 0.56 | 6.15 | 28.80 | 0.85 | 0.61 |
| (10) LNP1022 G502 | 1.76 | 8.66 | 2907.86 | 11.26 | 1.72 |

TABLE 46

MCP-1 measurements from Study 2

| Treatment group | Pre-bleed | 90 min | 6 hour | 24 hour | Day 7 |
|---|---|---|---|---|---|
| (1) TSS | 204.01 ± 46.39 | 197.62 ± 19.54 | 310.84 ± 45.87 | 179.07 ± 20.77 | 234.61 ± 71.79 |
| (2) LNP1021 G502 | 303.67 ± 36.37 | 337.63 ± 195.18 | 755.20 ± 581.45 | 339.75 ± 206.20 | 214.82 ± 40.81 |
| (3) LNP1021 G502 | 229.30 | 358.10 | 3182.00 | 413.56 | 178.30 |
| (4) LNP1022 G502 | 393.63 ± 187.81 | 467.72 ± 221.61 | 1852.94 ± 2199.66 | 497.12 ± 412.30 | 382.19 ± 67.27 |
| (5) LNP1023 G502 | 213.72 ± 8.85 | 196.18 ± 62.81 | 1722.18 ± 1413.90 | 197.83 ± 74.01 | 156.16 ± 18.87 |
| (6) LNP1024 G509 | 237.76 ± 96.36 | 210.37 ± 95.17 | 468.53 ± 250.42 | 22.32 ± 69.06 | 141.20 ± 71.90 |
| (7) LNP1024 G509 | 207.36 | 183.07 | 1885.66 | 235.70 | 163.11 |
| (8) LNP1025 G509 | 259.57 ± 112.98 | 299.21 ± 304.89 | 1193.10 ± 974.04 | 258.82 ± 88.53 | 219.86 ± 219.86 |
| (9) LNP1021 G502 | 199.29 | 286.04 | 2001.23 | 197.57 | 196.44 |
| (10) LNP1022 G502 | 305.81 | 970.65 | 7039.06 | 8379.05 | 203.47 |

TABLE 47

Complement C3a measurements from Study 3

| Treatment group | Pre-bleed | 90 min | 6 hour | 24 hour | Day 7 |
|---|---|---|---|---|---|
| (1) TSS | 42.47 ± 10.30 | 55.40 ± 13.58 | 29.30 ± 14.46 | 41.70 ± 23.65 | 27.43 ± 12.43 |
| (2) LNP1021 G502 | 34.37 ± 0.50 | 86.50 ± 3.66 | 90.07 ± 4.85 | 56.60 ± 2.25 | 32.53 ± 0.93 |
| (3) LNP1021 G502 | 34.30 | 128.00 | 93.30 | 33.40 | 28.20 |
| (4) LNP1022 G502 | 41.55 ± 13.51 | 151.37 ± 109.98 | 82.00 ± 31.82 | 45.57 ± 18.58 | 32.77 ± 6.45 |
| (5) LNP1023 G502 | 31.67 ± 3.19 | 74.40 ± 22.08 | 74.13 ± 48.61 | 33.83 ± 9.75 | 27.70 ± 8.05 |
| (6) LNP1024 G509 | 56.60 ± 25.61 | 100.37 ± 77.95 | 74.73 ± 70.15 | 55.20 ± 48.34 | 49.97 ± 39.94 |
| (7) LNP1024 G509 | 33.80 | 33.90 | 33.70 | 26.10 | 20.90 |
| (8) LNP1025 G509 | 39.90 ± 13.01 | 75.73 ± 1.38 | 46.13 ± 30.56 | 25.00 ± 3.80 | 23.90 ± 7.18 |
| (9) LNP1021 G502 | 34 | 85.70 | 133.00 | 62.00 | 25.50 |
| (10) LNP1022 G502 | 29.8 | 68.10 | 113.00 | 71.70 | 23.30 |

TABLE 48

Complement bb measurements from Study 3

| Treatment group | Pre-bleed | 90 min | 6 hour | 24 hour | Day 7 |
|---|---|---|---|---|---|
| (1) TSS | 1.46 ± 0.70 | 2.18 ± 0.78 | 1.96 ± 0.64 | 0.945 ± 0.15 | 1.34 ± 0.50 |
| (2) LNP1021 G502 | 1.77 ± 0.60 | 6.51 ± 3.66 | 11.00 ± 4.85 | 3.59 ± 2.25 | 2.07 ± 0.93 |
| (3) LNP1021 G502 | 1.24 | 2.90 | 11.50 | 2.97 | 1.24 |
| (4) LNP1022 G502 | 1.52 ± 0.34 | 5.67 ± 2.28 | 10.2 ± 3.36 | 3.66 ± 1.68 | 1.84 ± 0.24 |
| (5) LNP1023 G502 | 1.65 ± 0.94 | 4.4 ± 1 | 7.68 ± 4.67 | 2.64 ± 1.18 | 2.08 ± 1.32 |
| (6) LNP1024 G509 | 1.61 ± 0.13 | 4.52 ± 1.81 | 4.50 ± 3.22 | 1.63 ± 0.84 | 1.63 ± 0.32 |
| (7) LNP1024 G509 | 0.96 | 2.99 | 2.64 | 1.13 | 1.07 |
| (8) LNP1025 G509 | 1.37 ± 0.17 | 4.9 ± 4.51 | 3.79 ± 3.84 | 1.66 ± 1.43 | 1.35 ± 0.44 |
| (9) LNP1021 G502 | 1.41 | 5.67 | 11.50 | 4.64 | 1.38 |
| (10) LNP1022 G502 | 1.28 | 5.22 | 14.10 | 5.64 | 1.87 |

16. Comparison of Cas9 Expression of Different mRNA in Mouse Liver

Cas9 expression was measured in vivo following administration of different mRNAs encoding Cas9. Messenger RNAs as indicated in Table 49 were formulated as LNPs with a mouse sgRNA targeting the mouse TTR gene (sgRNA:mRNA weight ratio of 1:2). The LNPs were assembled using the cross flow procedure with 50% Lipid A, 9% DSPC, 38% cholesterol, and 3% PEG2k-DMG and an N:P ratio of 6.0. LNPs were purified using Sartocon Slice 200 (Sartorius) and used at a concentration of 1.53 mg/ml (RNA concentration). LNP formulations were analyzed for average particle size, polydispersity (pdi), total RNA content and encapsulation efficiency of RNA as described above (data not shown).

CD-1 female mice (n=5 per group) were dosed i.v. at 0.3 mpk. At 1 hour, 3 hours, and 6 hours post-dose, animals were sacrificed, liver tissue was collected, and Cas9 protein levels were measured by MSD ELISA as described in Example 11. Table 49 shows Cas9 protein levels. At each time point, more Cas9 protein is detected in animals that were treated with SEQ ID NO: 177 than in animals treated with SEQ ID NO: 43.

TABLE 49

| mRNA | Timepoint (Hours) | ng Cas9/g Liver | Std. Dev. | Sample size (n) |
|---|---|---|---|---|
| TSS | | 0 | 28 | 5 |
| SEQ ID NO: 43 | 1 | 429 | 164 | 5 |
| SEQ ID NO: 177 | 1 | 1872 | 907 | 5 |
| SEQ ID NO: 43 | 3 | 1167 | 814 | 5 |
| SEQ ID NO: 177 | 3 | 2233 | 929 | 5 |
| SEQ ID NO: 43 | 6 | 535 | 297 | 5 |
| SEQ ID NO: 177 | 6 | 1663 | 443 | 5 |

17. Comparison of Dose Response of Different mRNA

Dose response curves of different mRNAs encoding Cas9 in vivo were compared. LNP formulations were prepared with the mRNAs of SEQ ID No. 43 and SEQ ID No. 177 and sg502 (SEQ ID NO: 70; G502), formulating as described in Example 16. The lipid nanoparticle components were dissolved in 100% ethanol with the lipid component molar ratio of 50/9/38/3 (LPO1/DSPC/cholesterol/PEG-DMG). The LNPs were formulated with a lipid amine to RNA phosphate (N:P) molar ratio of about 6 with the ratio of gRNA to mRNA at 1:2 by weight. LNP formulations were analyzed for average particle size, polydispersity (pdi), total RNA content and encapsulation efficiency of RNA as described above (data not shown).

For in vivo characterization, CD-1 female mice (n=5 per group) were dosed intravenously at 0.03, 0.1, or 0.3 mg total RNA (mg guide RNA+mg mRNA) per kg (n=5 per group). At seven days post-dose, animals were sacrificed, blood and the liver were collected, and serum TTR and liver editing were measured as described in Example 1. Negative control animals were dosed with TSS vehicle. Editing data is provided in Table 50, below. For SEQ ID NO: 43, the average of 8 in vivo experiments, each with 5 animals is provided. For SEQ ID NO: 177, the average from an in vivo experiment, with 5 animals at each dose is provided. At each dose, the % editing is higher in animals that were treated with SEQ ID NO: 177 than in animals treated with SEQ ID NO: 43.

TABLE 50

| | % Editing | | |
|---|---|---|---|
| mRNA | 0.3 mg/kg dose Average (Range) | 0.1 mg/kg Average (Range) | 0.03 mg/kg Average (Range) |
| SEQ ID NO: 43 | 65.8% (62.2-71.2%) | 40.6% (29.2-55.6%) | 11.4% (6.2-20.1%) |
| SEQ ID NO: 177 | 71.2% | 58.9% | 29.3% |

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| Cas9 DNA coding sequence 2 | ATGGACAAGAAGTACAGCATCGGACTGGACATCGGAACAAACAGCGTCGGATGGGCAGTCATCACAGACGAATACAAGGTCCCGAGCAAGAAGTTCAAGGTCCTGGGAAACACAGACAGACACAGCATCAAGAAGAACCTGATCGGAGCACTGCTGTTCGACAGCGGAGAAACAGCAGAAGCAACAGAACTGAAGAGAACAGCAAGAAGAAGATACAAGAAGAAAGAACAGAATCTGCTACCTGCAGGAAATCTTCAGCAACGAAATGGCAAAGGTCGACGACAGCTTCTTCCACAGACTGGAAGAAAGCTTCCTGGTCGAAGAAGACAAGAAGCACGAAAGACACCCGATCTTCGGAAACATCGTCGACGAAGTCGCATACCACGAAAAGTACCCGACAATCTACCACCTGAGAAAGAAGCTGGTCGACAGCACAGACAAGGCAGACCTGAGACTGATCTACCTGGCACTGGCACACATGATCAAGTTCAGAGGACACTTCCTGATCGAAGGAGACCTGAACCCGGACAACAGCGACGTCGACAAGCTGTTCATCCAGCTGGTCCAGACATACAACCAGCTGTTCGAAGAAAACCCGATCAACGCAAGCGGAGTCGACGCAAAGGCAATCCTGAGCGCAAGACTGAGCAAGAGCAGAAGACTGGAAAACCTGATCGCACAGCTGCCGGAGAGAAAAGAAGAACGGACTGTTCGGAAACCTGATCGCACTGAGCCTGGGACTGACACCGAACTTCAAGAGCAACTTCGACCTGGCAGAAGACGCAAAGCTGCAGCTGAGCAAGGACACATACGACGACGACCTGGACAACCTGCTGGCACAGATCGGAGACCAGTACGCAGACCTGTTCCTGGCAGCAAAGAACCTGAGCGACGCAATCCTGCTGAGCGACATCCTGAGAGTCAACACAGAAATCACAAAGGCACCGCTGAGCGCAAGCATGATCAAGAGATACGACGAACACCACCAGGACCTGACACTGCTGAAGGCACTGGTCAGACAGCAGCTGCCGGAAAAGTACAAGGAAATCTTCTTCGACCAGAGCAAGAACGGATACGCAGGATACATCGACGGAGGAGCAAGCCAGGAAGAATTCTACAAGTTCATCAAGCCGATCCTGGAAAAGATGGACGGAACAGAAGAACTGCTGGTCAAGCTGAACAGAGAAGACCTGCTGAGAAAGCAGAGAACATTCGACAACGGAAGCATCCCGCACCAGATCCACCTGGGAGAACTGCACGCAATCCTGAGAAGACAGGAAGACTTCTACCCGTTCCTGAAGGACAACAGAGAAAAGATCGAAAAGATCCTGACATTCAGAATCCCGTACTACGTCGGACCGCTGGCAAGAGGAAACAGCAGATTCGCATGGATGACAAGAAAGAGCGAAGAAACAATCACACCGTGGAACTTCGAAGAAGTCGTCGACAAGGGAGCAAGCGCACAGAGCTTCATCGAAAGAATGACAAACTTCGACAAGAACCTGCCGAACGAAAAGGTCCTGCCGAAGCACAGCCTGCTGTACGAATACTTCACAGTCTACAACGAACTGACAAAGGTCAAGTACGTCACAGAAGGAATGAGAAAGCCGGCATTCCTGAGCGGAGAACAGAAGAAGGCAATCGTCGACCTGCTGTTCAAGACAAACAGAAAGGTCACAGTCAAGCAGCTGAAGGAAGACTACTTCAAGAAGATCGAATGCTTCGACAGCGTCGAAATCAGCGGAGTCGAAGACAGATTCAACGCAAGCCTGGGAACATACCACGACCTGCTGAAGATCATCAAGGACAAGGACTTCCTGGACAACGAAGAAAACGAAGACATCCTGGAAGACATCGTCCTGACACTGACACTGTTCGAAGACAGAGAAATGATCGAAGAAAGACTGAAGACATACGCACACCTGTTCGACGACAAGGTCATGAAGCAGCTGAAGAGAAGAAGATACACAGGATGGGGAAGACTGAGCAGAAAGCTGATCAACGGAATCAGAGACAAGCAGAGCGGAAAGACAATCCTGGACTTCCTGAAGAGCGACGGATTCGCAAACAGAAACTTCATGCAGCTGATCCACGACGACAGCCTGACATTCAAGGAAGACATCCAGAAGGCACAGGTCAGCGGACAGGGAGACAGCCTGCACGAACACATCGCAAACCTGGCAGGAAGCCCGGCAATCAAGAAGGGAATCCTGCAGACAGTCAAGGTCGTCGACGAACTGGTCAAGGTCATGGGAAGACACAAGCCGGAAAACATCGTCATCGAAATGGCAAGAGAAAACCAGACAACACAGAAGGGACAGAAGAACAGCAGAGAAAGAATGAAGAGAATCGAAGAAGGAATCAAGGAACTGGGAAGCCAGATCCTGAAGGAACACCCGGTCGAAAACACACAGCTGCAGAACGAAAAGCTGTACCTGTACTACCTGCAGAACGGAAGAGACATGTACGTCGACCAGGAACTGGACATCAACAGACTGAGCGACTACGACGTCGACCACATCGTCCCGCAGAGCTTCCTGAAGGACGACAGCATCGACAACAAGGTCCTGACAAGAAGCGACAAGAACAGAGGAAAGAGCGACAACGTCCCGAGCGAAGAAGTCGTCAAGAAGATGAAGAACTACTGGAGACAGCTGCTGAACGCAAAGCTGATCACACAGAGAAAGTTCGACAACCTGACAAAGGCAGAGAGGAGGACTGAGCGAACTGGACAAGGCAGGATTCATCAAGAGACAGCTGGTCGAAACAAGACAGATCACAAAGCACGTCGCACAGATCCTGGACAGCAGAATGAACACAAAGTACGACGAAAACGACAAGCTGATCAGAGAAGTCAAGGTCATCACACTGAAGAGCAAGCTGGTCAGCGACTTCAGAAAGGACTTCCAGTTCTACAAGGTCAGAGAAATCAACAACTACCACCACGCACACGACGCATACCTGAACGCAGTCGTCGGAACAGCACTGATCAAGAAGTACCCGAAGCTGGAAAGCGAATTCGTCTACGGAGACTACAAGGTCTACGACGTCAGAAAGATGATCGCAAAGAGCGAACAGGAAATCGGAAAGGCAACAGCAAAGTACTTCTTCTACAGCAACATCATGAACTTCTTCAAGACAGAAATCACACTGGCAAACGGAGAAATCAGAAAGAGACCGCTGATCGAAACAAACGGAGAAACAGGAGAAATCGTCTGGGACAAGGGAAGAGACTTCGCAACAGTCAGAAAGGTCCTGAGCATGCCGCAGGTCAACATCGTCAAGAAGACAGAAGTCCAGACAGGAGGATTCAGCAAGGAAAGCATCCTGCCGAAGAGAAACAGCGACAAGCTGATCGCAAGAAAGAAGGACTGGGACCCGAAGAAGTACGGAGGATTCGACAGCCCGACAGTCGCATACAGCGTCCTGGTCGTCGCAAAGGTCGAAAAGGGAAAGAGCAAGAAGCTGAAGAGCGTCAAGGAACTGCTGGGAATCACAATCATGGAAAGAAGCAGCTTCGAAAAGAACCCGATCGACTTCCTGGAAGCAAAGGGATACAAGGAAGTCAAGAAGGACCTGATCATCAAGCTGCCGAAGTACAGCCTGTTCGAACTGGAAAACGGA | 1 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | AGAAAGAGAATGCTGGCAAGCGCAGGAGAACTGCAGAAGG-GAAACGAACTGGCACTGCCGAGCAAGTACGTCAACTTCCTGTACCTGGCAAGC CACTACGAAAAGCTGAAGGGAAGCCCGGAA-GACAACGAACAGAAGCAGCTGTTCGTCGAACAGCACAAGCACTACCTGGACGAAATCATCGAA CAGATCAGCGAATTCAGCAAGAGAGTCATCCTGGCAGACGCAAACCTGGACAAGGTCCT-GAGCGCATACAACAAGCACAGAGACAAGCCGATC AGAGAACAGGCAGAAAACATCATCCACCTGTTCACACTGACAAACCTGG-GAGCACCGGCAGCATTCAAGTACTTCGACACAACAATCGACAGA AAGAGATACACAAGCACAAAGGAAGTCCTGGACGCAACACTGATCCACCAGAGCAT-CACAGGACTGTACGAAACAAGAATCGACCTGAGCCAG CTGGGAGGAGACGGAGGAGGAAGCCCGAAGAAGAAGAGAAAGGTCTAG | |
| Cas9 DNA coding sequence 1 | ATGGATAAGAAGTACTCAATCGGGCTGGATATCGGAACTAATTCCGTGGGTTGGGCAGT-GATCACGGATGAATACAAAGTGCCGTCCAAGAAG TTCAAGGTCCTGGGGAACACCGATAGACACAGCATCAAGAAAAATCTCATCG-GAGCCCTGCTGTTTGACTCCGGCGAAACCGCAGAAGCGACC CGGCTCAAACGTACCGCGAGGCGACGCTACACCCGGCGGAAGAATCGCATCTGC-TATCTGCAAGAGATCTTTTCGAACGAAATGGCAAAGGTC GACGACAGCTTCTTCCACCGCCTGGAAGAATCTTTCCTGGTGGAGGAGGACAAGAAGCAT-GAACGGCATCCTATCTTTGGAAACATCGTCGAC GAAGTGGCGTACCACGAAAAGTACCCGACCATCTACCATCTGCG-GAAGAAGTTGGTTGACTCAACTGACAAGGCCGACCTCAGATTGATCTAC TTGGCCCTCGCCCATATGATCAAATTCCGCGGACACTTCCTGATCGAAGGCGATCT-GAACCCTGATAACTCCGACGTGGATAAGCTTTTCATT CAACTGGTGCAGACCTACAACCAACTGTTCGAAGAAAACCCAATCAATGCTAGCGGCGTC-GATGCCAAGGCCATCCTGTCCGCCCGGCTGTCG AAGTCGCGGCGCCTCGAAAACCTGATCGCACAGCTGCCGG-GAGAGAAAAGAACGGACTTTTCGGCAACTTGATCGCTCTCTCACTGGGACTC ACTCCCAATTTCAAGTCCAATTTTGACCTGGCCGAGGACGCGAAGCTGCAACTCT-CAAAGGACACCTACGACGACGACTTGGACAATTTGCTG GCACAAATTGGCGATCAGTACGCG-GATCTGTTCCTTGCCGCTAAGAACCTTTCGGACGCAATCTTGCTGTCCGATATCCTGCGCGTGAACACC GAAATAACCAAAGCGCCGCTTAGCGCCTCGATGATTAAGCGGTACGACGAGCATCACCAG-GATCTCACGCTGCTCAAAGCGCTCGTGAGACAG CAACTGCCTGAAAAGTACAAGGAGATCTTCTTCGACCAGTC-CAAGAATGGGTACGCAGGGTACATCGATGAGGCGCTAGCCAGGAAGAGTTC TATAAGTTCATCAAGCCAATCCTGGAAAAGATGGACGGAACCGAAGAACTGCTGGT-CAAGCTGAACAGGGAGGATCTGCTCCGGAAACAGAGA ACCTTTGACAACGGATCCATTCCCCACCAGATCCATCTGGGTGAGCTGCACGC-CATCTTGCGGCGCCAGGAGGACTTTTACCCATTCCTCAAG GACAACCGGGAAAAGATCGAGAAATTCTGACGTTCCGCATCCCGTATTACGTGGGCC-CACTGGCGCGCGGCAATTCGCGCTTCGCGTGGATG ACTAGAAAATCAGAGGGAAACCATCACTCCTTGGAATTTCGAGGAAGTTGTGGATAAGG-GAGCTTCGGCACAAAGCTTCATCGAACGAATGACC AACTTCGACAAGAATCTCCCAAACGAGAAGGTGCTTCCTAAGCACAGCCTCCTT-TACGAATACTTCACTGTCTACAACGAACTGACTAAAGTG AAATACGTTACTGAAGGAATGAGGAAGCCGGCCTTTCTGTCCG-GAGAACAGAAGAAAGCAATTGTCGATCTGCTGTTCAAGACCAACCGCAAG GTGACCGTCAAGCAGCTTAAAGAGGACTACTTCAAGAAGATCGAGTGTTTCGACTCAGTG-GAAATCAGCGGGGTGGAGGACAGATTCAACGCT TCGCTGGGAACCTATCATGATCTCCTGAAGATCAT-CAAGGACAAGGACTTCCTTGACAACGAGGAGAACGAGGACATCCTGGAAGATATCGTC CTGACCTTGACCCTTTTCGAGGATCGCGAGATGATCGAGGAGAGGCTTAAGACCTACGCT-CATCTCTTCGACGATAAGGTCATGAAACAACTC AAGCGCCGCCGGTACACTGGTTGGGGCCGCCTCTCCCGCAAGCTGATCAACGGTATTCGC-GATAAACAGAGCGGTAAAACTATCCTGGATTTC CTCAAATCGGATGGCTTCGCTAATCGTAACTTCATGCAATTGATC-CACGACGACAGCCTGACCTTTAAGGAGGACATCCAAAAAGCACAAGTG TCCGGACAGGGAGACTCACTCCATGAACACATCGCGAATCTGGCCGGTTCGCCGGCGAT-TAAGAAGGGAATTCTGCAAACTGTGAAGGTGGTC GACGAGCTGGTGAAGGTCATGGGACGGCACAAACCGGAGAATATCGTGATT-GAAATGGCCCGAGAAAACCAGACTACCCAGAAGGGCCAGAAA AACTCCCGCGAAAGGATGAAGCGGATCGAAGAAGGAATCAAGGAGCTGGGCAGCCA-GATCCTGAAAGAGCACCCGGTGGAAAACACGCAGCTG CAGAACGAGAAGCTCTACCTGTACTATTTGCAAAATGGACGGGACATGTACGTGGAC-CAAGAGCTGGACATCAATCGGTTGTCTGATTACGAC GTGGACCACATCGTTCCACAGTCCTTTCTGAAGGATGACTCGATCGA-TAACAAGGTGTTGACTCGCAGCGACAAGAACAGAGGGAAGTCAGAT AATGTGCCATCGGAGGAGGTCGTGAAGAAGATGAAGAATTACTGGCGGCAGCTCCT-GAATGCGAAGCTGATTACCCAGAGAAAGTTTGACAAT CTCACTAAAGCCGAGCGCGGCGGACTCTCAGAGCTGGATAAGGCTGGATTCAT-CAAACGCCAGCTGGTCGAGACTCGGCAGATTACCAAGCAC GTGGCGCAGATCTTGGACTCCCGCATGAACACTAAATACGACGAGAACGATAAGCT-CATCCGGGAAGTGAAGGTGATTACCCTGAAAAGCAAA CTTGTGTCGGACTTTCGGAAGGACTTTCAGTTTTACAAAGTGAGAGAAATCAACAACTAC-CATCACGCGCATGACGCATACCTCAACGCTGTG | 2 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | GTCGGTACCGCCCTGATCAAAAAGTACCCTAAACTTGAATCGGAGTTTGTGTACGGAGAC-TACAAGGTCTACGACGTGAGGAAGATGATAGCC AAGTCCGAACAGGAAATCGGGAAAGCAACTGCGAAATACTTCTTTTACTCAAACATCAT-GAACTTTTTCAAGACTGAAATTACGCTGGCCAAT GGAGAAATCAGGAAGAGGCCACTGATCGAAACTAACG-GAGAAACGGGCGAAATCGTGTGGGACAAGGGCAGGGACTTCGCAACTGTTCGCAAA GTGCTCTCTATGCCGCAAGTCAATATTGTGAAGAAAACCGAAGTGCAAACCGGCGGAT-TTTCAAAGGAATCGATCCTCCCAAAGAGAAATAGC GACAAGCTCATTGCACGCAAGAAAGACTGGGACCCGAAGAAGTACGGAGGATTCGAT-TCGCCGACTGTCGCATACTCCGTCCTCGTGGTGGCC AAGGTGGAGAAGGGAAAGAGCAAAAAGCTCAAATCCGTCAAAGAGCTGCTGGGGATTAC-CATCATGGAACGATCCTCGTTCGAGAAGAACCCG ATTGATTTCCTCGAGGCGAAGGGTTACAAGGAGGTGAAGAAGGATCTGATCAT-CAAACTCCCCAAGTACTCACTGTTCGAACTGGAAAATGGT CGGAAGCGCATGCTGGCTTCGGCCGGAGAACTCCAAAAAGGAAAT-GAGCTGGCCTTGCCTAGCAAGTACGTCAACTTCCTCTATCTTGCTTCG CACTACGAAAAACTCAAAGGGTCACCGGAAGATAACGAACAGAAGCAGCTTTTCGTG-GAGCAGCACAAGCATTATCTGGATGAAATCATCGAA CAAATCTCCGAGTTTTCAAAGCGCGTGATCCTCGCCGACGC-CAACCTCGACAAAGTCCTGTCGGCCTACAATAAGCATAGAGATAAGCCGATC AGAGAACAGGCCGAGAACATTATCCACTTGTTCACCCTGACTAACCTGG-GAGCCCCAGCCGCCTTCAAGTACTTCGATACTACTATCGATCGC AAAAGATACACGTCCACCAAGGAAGTTCTGGACGCGACCCTGATCCACCAAAGCAT-CACTGGACTCTACGAAACTAGGATCGATCTGTCGCAG CTGGGTGGCGATGGCGGTGGATCTCCGAAAAAGAAGAGAAAGGTGTAATGA | |
| Cas9 amino acid sequence | MDKKYSIGLDIGTNSVGWAVITDEYKVPSKKFKVLGNTDRHSIKKNLIGALLFDSGETAE-ATRLKRTARRRYTRRKNRICYLQEIFSNEMAKV DDSFFHRLEESFLVEEDKKHERHPIFGNIVDEVAYHEKYPTIYHLRKKLVD-STDKADLRLIYLALAHMIKFRGHFLIEGDLNPDNSDVDKLFI QLVQTYNQLFEENPINASGVDAKAILSARLSKSRRLENLIAQLPGEKKNGLFGNLIA-LSLGLTPNEKSNFDLAEDAKLQLSKDTYDDDLDNLL AQIGDQYADLFLAAKNLSDAILLSDILRVNTEITKAPLSASMIKRYDEHHQDLTLLKA-LVRQQLPEKYKEIFFDQSKNGYAGYIDGGASQEEF YKFIKPILEKMDGTEELLVKLNREDLLRKQRTFDNGSIPHQIHLGELHAILRRQEDFYP-FLKDNREKIEKILTFRIPYYVGPLARGNSRFAWM TRKSEETITPWNFEEVVDKGASAQSFIERMTNFDKNLPNEKVLPKHSLLY-EYFTVYNELTKVKYVTEGMRKPAFLSGEQKKAIVDLLFKTNRK VTVKQLKEDYFKKIECFDSVEISGVEDRFNASLGTYHDLLKIIKDKDFLDNEENEDILE-DIVLTLTLFEDREMIEERLKTYAHLFDDKVMKQL KRRRYTGWGRLSRKLINGIRDKQSGKTILDFLKSDGFANRNFMQLIHDD-SLTFKEDIQKAQVSGQGDSLHEHIANLAGSPAIKKGILQTVKVV DELVKVMGRHKPENIVIEMARENQTTQKGQKNSRERMKRIEEGIKEL-GSQILKEHPVENTQLQNEKLYLYYLQNGRDMYVDQELDINRLSDYD VDHIVPQSFLKDDSIDNKVLTRSDKNRGKSDNVPSEEVVKKMKNYWRQLLNAK-LITQRKFDNLTKAERGGLSELDKAGFIKRQLVETRQITKH VAQILDSRMNTKYDENDKLIREVKVITLKSKLVSDFRKDFQFYKVREINNYHHAHDAYL-NAVVGTALIKKYPKLESEFVYGDYKVDVRKMIA KSEQEIGKATAKYFFYSNIMNFFKTEITLANGEIRKRPLIETNGETGEIVWDKGRDFA-TVRKVLSMPQVNIVKKTEVQTGGFSKESILPKRNS DKLIARKKDWDPKKYGGFDSPTVAYSVLVVAKVEKGKSKKLKSVKELLGITIMERSS-FEKNPIDFLEAKGYKEVKKDLIIKLPKYSLFELENG RKRMLASAGELQKGNELALPSKYVNFLYLASHYEKLKGSPEDNEQKQLFVEQHKHYL-DEIIEQISEFSKRVILADANLDKVLSAYNKHRDKPI REQAENIIHLFTLTNLGAPAAFKYFDTTIDRKRYTSTKEVLDATLIHQSITGLYETRIDLSQLGGDGGGSPKKKRKV | 3 |
| Cas9 mRNA open reading frame (ORF) 2 | AUGGACAAGAAGUACAGCAUCGGACUGGACAUCGGAACAAACAGCGUCGGAUGGGCAGU-CAUCACAGACGAAUACAAGGUCCCGAGCAAGAAG UUCAAGGUCCUGGGAAACACAGACAGACACAGCAUCAAGAAGAACCUGAUCGGAGCA-CUGCUGUUCGACAGCGGAGAAACAGCAGAAGCAACA AGACUGAAGAGAACAGCACAAGAAGAAGAUACAAGAAGAAAGAACAGAAUCUGCUAC-CUGCAGGAAAUCUUCAGCAACGAAAUGGAAAGGUC GACGACAGCUUCUUCCACAGACUGGAAGAAAGCUUCCUGGUCGAAGAA-GACAAGAAGCACGAAAGACACCCGAUCUUCGGAAACAUCGUCGAC GAAGUCGCAUACCACGAAAAGUACCCGACAAUCUACCACCUGAGAAAGAAGCUGGU-CGACAGCACAGACAAGGCAGACCUGAGACUGAUCUAC CUGGCACUGGCACACAUGAUCAAGUUCAGAGGACACUUCCUGAUCGAAGGAGAC-CUGAACCCGGACAACAGCGACGUCGACAAGCUGUUCAUC CAGCUGGUCCAGACAUACAACCAGCUGUUCGAAGAAAACCCGAUCAACGCAAGCGGAGU-CGACGCAAAGGCAAUCCUGAGCGCAAGACUGAGC AAGAGCAGAAGACUGGAAAACCUGAUCGCACAGCUGCCGGGAGAAAAGAAGAACGGACU-GUUCGGAAACCUGAUCGCACUGAGCCUGGGACUG ACACCGAACUUCAAGAGCAACUUCGACCUGGCAGAA-GACGCAAAGCUGCAGCUGAGCAAGGACACAUACGACGACGACCUGGACAACCUGCUG GCACAGAUCGGAGACCAGUACGCAGACCUGUUCCUGGCAGCAAAGAAC-CUGAGCGACGCAAUCCUGCUGAGCGACAUCCUGAGAGUCAACACA | 4 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | GAAAUCACAAAGGCACCGCUGAGCGCAAGCAUGAUCAAGAGAUACGACGAACAC-CACCAGGACCUGACACUGCUGAAGGCACUGGUCAGACAG | |
| | CAGCUGCCGGAAAAGUACAAGGAAAUCUUCUUCGACCAGAGCAAGAACGGAUACGCAG-GAUACAUCGACGGAGGAGCAAGCCAGGAAGAAUUC | |
| | UACAAGUUCAUCAAGCCGAUCCUGGAAAAGAUGGACGGAACAGAAGAACUGCUGGU-CAAGCUGAACAGAGAAGACCUGCUGAGAAAGCAGAGA | |
| | ACAUUCGACAACGGAAGCAUCCCGCACCAGAUCCACCUGGGAGAACUGCACGCAAUC-CUGAGAAGACAGGAAGACUUCUACCCGUUCCUGAAG | |
| | GACAACAGAGAAAAGAUCGAAAAGAUCCUGACAUUCAGAAUCCCGUACUACGU-CGGACCGCUGGCAAGAGGAAACAGCAGAUUCGCAUGGAUG | |
| | ACAAGAAAGAGCGAAGAAACAAUCACACCGUGGAACUUCGAAGAAGUCGUCGACAAGG-GAGCAAGCGCACAGAGCUUCAUCGAAAGAAUGACA | |
| | AACUUCGACAAGAACCUGCCGAACGAAAAGGUCCUGCCGAAGCACAGCCUGCU-GUACGAAUACUUCACAGUCUACAACGAACUGACAAAGGUC | |
| | AAGUACGUCACAGAAGGAAUGAGAAAGCCGGCAUUCCUGAGCG-GAGAACAGAAGAAGGCAAUCGUCGACCUGCUGUUCAAGACAAACAGAAAG | |
| | GUCACAGUCAAGCAGCUGAAGGAAGACUACUUCAAGAAGAUCGAAUGCUUCGACAGCGU-CGAAAUCAGCGGAGUCGAAGACAGAUUCAACGCA | |
| | AGCCUGGGAACAUACCACGACCUGCUGAAGAUCAUCAAGGACAAGGACUUC-CUGGACAACGAAGAAAAACGAAGACAUCCUGGAAGACAUCGUC | |
| | CUGACACUGACACUGUUCGAAGACAGAGAAAUGAUCGAAGAAGACUGAAGA-CAUACGCACACCUGUUCGACGACAAGGUCAUGAAGCAGCUG | |
| | AAGAGAAGAAGAUACACAGGAUGGGGAAGACUGAGCAGAAAGCUGAUCAACGGAAUCAGA-GACAAGCAGAGCGGAAAGACAAUCCUGGACUUC | |
| | CUGAAGAGCGACGGAUUCGCAAACAGAAACUUCAUGCAGCUGAUCCACGACGACAGC-CUGACAUUCAAGGAAGACAUCCAGAAGGCACAGGUC | |
| | AGCGGACAGGGAGACAGCCUGCACGAACACAUCGCAAACCUGGCAGGAAGCCCGGCAAU-CAAGAAGGGAAUCCUGCAGACAGUCAAGGUCGUC | |
| | GACGAACUGGUCAAGGUCAUGGGAAGACACAAGCCGGAAAACAUCGU-CAUCGAAAUGGCAAGAGAAAACCAGACAACACAGAAGGGACAGAAG | |
| | AACAGCAGAGAAAGAAUGAAGAGAAUCGAAGAAGGAAUCAAGGAACUGGGAAGCCAGAUC-CUGAAGGAACACCCGGUCGAAAACACACAGCUG | |
| | CAGAACGAAAAGCUGUACCUGUACUACCUGCAGAACGGAAGAGACAUGUACGUCGACCAG-GAACUGGACAUCAACAGACUGAGCGACUACGAC | |
| | GUCGACCACAUCGUCCCGCAGAGCUUCCUGAAGGACGACAGCAUCGACAACAAGGUC-CUGACAAGAAGCGACAAGAACAGAGGAAAGAGCGAC | |
| | AACGUCCCGAGCGAAGAAGUCGUCAAGAAGAUGAAGAACUACUGGA-GACAGCUGCUGAACGCAAAGCUGAUCACACAGAGAAAGUUCGACAAC | |
| | CUGACAAAGGCAGAGAGGAGGAGGACUGAGCGAACUGGACAAGGCAGGAUUCAUCAAGA-GACAGCUGGUCGAAACAAGACAGAUCACAAAGCAC | |
| | GUCGCACAGAUCCUGGACAGCAGAAUGAACACAA-AGUACGACGAAAACGACAAGCUGAUCAGAGAAGUCAAGGUCAUCACACUGAAGAGCAAG | |
| | CUGGUCAGCGACUUCAGAAAGGACUUCCAGUUCUACAAGGUCAGAGAAAUCAACAACUAC-CACCACGCACACGACGCAUACCUGAACGCAGUC | |
| | GUCGGAACAGCACUGAUCAAGAAGUACCCGAAGCUGGAAAGCGAAUUCGUCUACGGAGAC-UACAAGGUCUACGACGUCAGAAAGAUGAUCGCA | |
| | AAGAGCGAACAGGAAAUCGGAAAGGCAACAGCAAAGUACUUCUUCUACAGCAACAU-CAUGAACUUCUUCAAGACAGAAAUCACACUGGCAAAC | |
| | GGAGAAAUCAGAAAGAGACCGCUGAUCGAAACAAACGGAGAAACAGGAGAAAUCGU-CUGGGACAAGGGAAGAGACUUCGCAACAGUCAGAAAG | |
| | GUCCUGAGCAUGCCGCAGGUCAACAUCGUCAAGAAGACAGAAGUCCAGACAGGAG-GAUUCAGCAAGGAAAGCAUCCUGCCGAAGAGAAACAGC | |
| | GACAAGCUGAUCGCAAGAAAGAAGGACUGGGACCCGAAGAAGUACGGAG-GAUUCGACAGCCCGACAGUCGCAUACAGCGUCCUGGUCGUCGCA | |
| | AAGGUCGAAAAGGGAAAGAGCAAGAAGCUGAAGAGCGUCAAGGAACUGCUGGGAAU-CACAAUCAUGGAAAGAAGCAGCUUCGAAAAGAACCCG | |
| | AUCGACUUCCUGGAAGCAAAGGGAUACAAGGAAGUCAAGAAGGACCUGAUCAU-CAAGCUGCCGAAGUACAGCCUGUUCGAACUGGAAAACGGA | |
| | AGAAAGAGAAUGCUGGCAAGCGCAGGAGAACUGCAGAAGGGAAACGAACUGGCA-CUGCCGAGCAAGUACGUCAACUUCCUGUACCUGGCAAGC | |
| | CACUACGAAAAGCUGAAGGGAAGCCCGGAAGACAACGAACAGAAGCAGCUGUUCGU-CGAACAGCACAAGCACUACCUGGACGAAAUCAUCGAA | |
| | CAGAUCAGCGAAUUCAGCAAGAGAGUCAUCCUGGCAGACGCAAACCUGGACAAGGUC-CUGAGCGCAUACAACAAGCACAGAGACAAGCCGAUC | |
| | AGAGAACAGGCAGAAAACAUCAUCCCACCUGUUCACACUGACAAACCUGG-GAGCACCGGCAGCAUUCAAGUACUUCGACACAACAAUCGACAGA | |
| | AAGAGAUACACAAGCACAAAGGAAGUCCUGGACGCAACACUGAUCCACCAGAGCAU-CACAGGACUGUACGAAACAAGAAUCGACCUGAGCCAG | |
| | CUGGGAGGAGACGGAGGAGGAAGCCCGAAGAAGAAGAGAAAGGUCUAG | |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| Cas9 mRNA ORF 1 | AUGGAUAAGAAGUACUCAAUCGGGCUGGAUAUCGGAACUAAUUCCGUGG-<br>GUUGGGCAGUGAUCACGGAUGAAUACAAAGUGCCGUCCAAGAAG<br>UUCAAGGUCCUGGGGAACACCGAUAGACACAGCAUCAAGAAAAAUCUCAUCGGAGCC-<br>CUGCUGUUUGACUCCGGCGAAACCGCAGAAGCGACC<br>CGGCUCAAACGUACCGCGAGGCGACGCUACACCCGGCGGAAGAAUCGCAUCUGC-<br>UAUCUGCAAGAGAUCUUUUCGAACGAAAUGGCAAAGGUC<br>GACGACAGCUUCUUCCACCGCCUGGAAGAAUCUUUCCUGGUGGAG-<br>GAGGACAAGAAGCAUGAACGGCAUCCUAUCUUUGGAAACAUCGUCGAC<br>GAAGUGGCGUACCACGAAAAGUACCCGACCAUCUACCAUCUGCGGAAGAAGUUGGUUGA-<br>CUCAACUGACAAGGCCGACCUCAGAUUGAUCUAC<br>UUGGCCCUCGCCCAUAUGAUCAAAUUCCGCGGACACUUC-<br>CUGAUCGAAGGCGAUCUGAACCCUGAUAACUCCGACGUGGAUAAGCUUUUCAUU<br>CAACUGGUGCAGACCUACAACCAACUGUUCGAAGAAAAACCCAAUCAAUGCUAGCGGCGU-<br>CGAUGCCAAGGCCAUCCUGUCCGCCCGGCUGUCG<br>AAGUCGCGGCGCCUCGAAAACCUGAUCGCACAGCUGCCGGGAGAGAAAAGAACGGAC-<br>UUUUCGGCAACUUGAUCGCUCUCUCACUGGGACUC<br>ACUCCCAAUUUCAAGUCCAAUUUUGACCUGGCCGAGGACGCGAAGCUGCAACUCU-<br>CAAAGGACACCUACGACGACGACUUGGACAAUUUGCUG<br>GCACAAAUUGGCGAUCAGUACGCGGAUCUGUUCCUUGCCGCUAAGAACC-<br>UUUCGGACGCAAUCUUGCUGUCCGAUAUCCUGCGCGUGAACACC<br>GAAAUAACCAAAGCGCCGCUUAGCGCCCUCGAUGAUUAAGCGGUACGACGAGCAUCACCAG-<br>GAUCUCACGCUGCUCAAAGCGCUCGUGAGACAG<br>CAACUGCCUGAAAAGUACAAGGAGAUCUUCUUCGACCAGUCCAAGAAUGGGUACGCAGG-<br>GUACAUCGAUGGAGGCGCUAGCCAGGAAGAGUUC<br>UAUAAGUUCAUCAAGCCAAUCCUGGAAAAGAUGGACGGAACCGAAGAACUGCUGGU-<br>CAAGCUGAACAGGGAGGAUCUGCUCCGGAAACAGAGA<br>ACCUUUGACAACGGAUCCAUUCCCCACCAGAUCCAUCUGGGGUGAGCUGCACGCCAUC-<br>UUGCGGCGCCAGGAGGACUUUUACCCAUUCCUCAAG<br>GACAACCGGGAAAAGAUCGAGAAAAUUCUGACGUUCCGCAUCCCGUAUUACGUGGGCCCA-<br>CUGGCGCGCGGCAAUUCGCGCUUCGCGUGGAUG<br>ACUAGAAAAUCAGAGGAAACCAUCACUCCUUGGAAUUUCGAGGAAGUUGUGGAUAAGG-<br>GAGCUUCGGCACAAAGCUUCAUCGAACGAAUGACC<br>AACUUCGACAAGAAUCUCCCAAACGAGAAGGUGCUUCCUAAGCACAGCCUCC-<br>UUUACGAAUACUUCACUGUCUACAACGAACUGACUAAAGUG<br>AAAUACGUUACUGAAGGAAUGAGGAAGCCGGCCUUUCUGUCCG-<br>GAGAACAGAAGAAAGCAAUUGUCGAUCUGCUGUUCAAGACCAACCGCAAG<br>GUGACCGUCAAGCAGCUUAAAGAGGACUACUUCAAGAAGAUCGAGUGUUUCGACUCAGUG-<br>GAAAUCAGCGGGGUGGAGGACAGAUUCAACGCU<br>UCGCUGGGAACCUAUCAUGAUCUCCCUGAAGAUCAUCAAGGACAAGGACUUCC-<br>UUGACAACGAGGAGAACGAGGACAUCCUGGAAGAUAUCGUC<br>CUGACCUUGACCCUUUUCGAGGAUCGCGAGAUGAUCGAGGAGAGGCUUAAGACCUACGCU-<br>CAUCUCUUCGACGAUAAGGUCAUGAAACAACUC<br>AAGCGCCGCCGGUACACUGGUUGGGGCCGCCUCUCCCGCAAGCUGAUCAACG-<br>GUAUUCGCGAUAAACAGAGCGGUAAAACUAUCCUGGAUUUC<br>CUCAAAUCGGAUGGCUUCGCUAAUCGUAACUUCAUGCAAUUGAUCCACGACGACAGC-<br>CUGACCUUUAAGGAGGACAUCCAAAAAGCACAAGUG<br>UCCGGACAGGGAGACUCACUCCAUGAACACAUCGCGAAUCUGGCCG-<br>GUUCGCCGGCGAUUAAGAAGGGAAUUCUGCAAACUGUGAAGGUGGUC<br>GACGAGCUGGUGAAGGUCAUGGGACGGCACAAACCG-<br>GAGAAUAUCGUGAUUGAAAUGGCCCGAGAAAACCAGACUACCCAGAAGGGCCAGAAA<br>AACUCCCGCGAAAGGAUGAAGCGGAUCGAAGAAGGAAUCAAGGAGCUGGGCAGCCAGAUC-<br>CUGAAAGAGCACCCGGUGGAAAACACGCAGCUG<br>CAGAACGAGAAGCUCUACCUGUACUAUUUGCAAAAUGGACGGGACAUGUACGUGGAC-<br>CAAGAGCUGGACAUCAAUCUGUUGUCUGAUUACGAC<br>GUGGACCACAUCGUUCCACAGUCCUUUCUGAAGGAUGACUCGAUCGAUAACAAGGU-<br>GUUGACUCGCAGCGACAAGAACAGAGGGAAGUCAGAU<br>AAUGUGCCAUCGGAGGAGGUCGUGAAGAAGAUGAAGAAUUACUGGCGGCAGCUC-<br>CUGAAUGCGAAGCUGAUUACCCAGAGAAAGUUUGACAAU<br>CUCACUAAAGCCGAGCGCGGCGGACUCUCAGAGCUGGAUAAGGCUGGAUUCAU-<br>CAAACGGCAGCUGGUCGAGACUCGGCAGAUUACCAAGCAC<br>GUGGCGCAGAUCUUGGACUCCCGCAUGAACACUAAAUACGACGAGAACGAUAAGCU-<br>CAUCCGGGAAGUGAAGGUGAUUACCCUGAAAAGCAAA<br>CUUGUGUCGGACUUUCGGAAGGACUUUCAGUUUUACAAAGUGAGAGAAAUCAACAACUAC-<br>CAUCACGCGCAUGACGCAUACCUCAACGCUGUG<br>GUCGGUACCGCCCUGAUCAAAAAGUACCCUAAACUUGAAUCGGAGUUUGUGUACGGAGAC-<br>UACAAGGUCUACGACGUGAGGAAGAUGAUAGCC<br>AAGUCCGAACAGGAAAUCGGGAAAGCAACUGCGAAAUACUUCUUUUACUCAAACAU-<br>CAUGAACUUUUUCAAGACUGAAAUUACGCUGGCCAAU<br>GGAGAAAUCAGGAAGAGGCCACUGAUCGAAACUAACGGAGAAACGGGCGAAAUCGU-<br>GUGGGACAAGGCCAGGGACUUCGCAACUGUUCGCAAA<br>GUGCUCUCUAUGCCGCAAGUCAAUAUUGUGAAGAAAACCGAAGUGCAAACCGGCG-<br>GAUUUUCAAAGGAAUCGAUCCUCCCAAAGAGAAAUAGC<br>GACAAGCUCAUUGCACGCAAGAAAGACUGGGACCCGAAGAAGUACGGAG-<br>GAUUCGAUUCGCCGACUGUCGCAUACUCCGUCCUCGUGGUGGCC | 5 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | AAGGUGGAGAAGGGAAAGAGCAAAAAGCUCAAAUCCGUCAAAGAGCUGCUGGGGAUUAC-<br>CAUCAUGGAACGAUCCUCGUUCGAGAAGAACCCG<br>AUUGAUUUCCUCGAGGCGAAGGGUUACAAGGAGGUGAAGAAGGAUCUGAUCAUCAAA-<br>CUCCCCAAGUACUCACUGUUCGAACUGGAAAAUGGU<br>CGGAAGCGCAUGCUGGCUUCGGCCGGAGAACUCCAAAAAGGAAAUGAGCUGGCCUUGCC-<br>UAGCAAGUACGUCAACUUCCUCUAUCUUGCUUCG<br>CACUACGAAAAACUCAAAGGGUCACCGGAAGAUAACGAACAGAAGCAGCUUUUCGUG-<br>GAGCAGCACAAGCAUUAUCUGGAUGAAAUCAUCGAA<br>CAAAUCUCCGAGUUUUCAAAGCGCUGAUCCUCGCCGACGCCAACCUCGACAAAGUCCU-<br>GUCGGCCUACAAUAAGCAUAGAGAUAAGCCGAUC<br>AGAGAACAGGCCGAGAACAUUAUCCACUUGUUCACCCUGACUAACCUGG-<br>GAGCCCCAGCCGCCUUCAAGUACUUCGAUACUACUAUCGAUCGC<br>AAAAGAUACACGUCCACCAAGGAAGUUCUGGACGCGACCCUGAUCCACCAAAGCAUCA-<br>CUGGACUCUACGAAACUAGGAUCGAUCUGUCGCAG<br>CUGGGUGGCGAUGGCGGUGGAUCUCCGAAAAAGAAGAGAAAGGUGUAAUGA | |
| Cas9<br>nickase<br>(D10A)<br>amino acid<br>sequence | MDKKYSIGLAIGTNSVGWAVITDEYKVPSKKFKVLGNTDRHSIKKNLIGALLFDSGETAE-<br>ATRLKRTARRRYTRRKNRICYLQEIFSNEMAKV<br>DDSFFHRLEESFLVEEDKKHERHPIFGNIVDEVAYHEKYPTIYHLRKKLVD-<br>STDKADLRLIYLALAHMIKFRGHFLIEGDLNPDNSDVDKLFI<br>QLVQTYNQLFEENPINASGVDAKAILSARLSKSRRLENLIAQLPGEKKNGLFGNLIA-<br>LSLGLIPNFKSNFDLAEDAKLQLSKDTYDDDLDNLL<br>AQIGDQYADLFLAAKNLSDAILLSDILRVNTEITKAPLSASMIKRYDEHHQDLTLLKA-<br>LVRQQLPEKYKEIFFDQSKNGYAGYIDGGASQEEF<br>YKFIKPILEKMDGTEELLVKLNREDLLRKQRTFDNGSIPHQIHLGELHAILRRQEDFYP-<br>FLKDNREKIEKILTFRIPYYVGPLARGNSRFAWM<br>TRKSEETITPWNFEEVVDKGASAQSFIERMINFDKNLPNEKVLPKHSLLY-<br>EYFTVYNELTKVKYVTEGMRKPAFLSGEQKKAIVDLLFKTNRK<br>VTVKQLKEDYFKKIECFDSVEISGVEDRFNASLGTYHDLLKIIKDKDFLDNEENEDILE-<br>DIVLILTLFEDREMIEERLKTYAHLFDDKVMKQL<br>KRRRYTGWGRLSRKLINGIRDKQSGKTILDFLKSDGFANRNFMQLIHDD-<br>SLIFKEDIQKAQVSGQGDSLHEHIANLAGSPAIKKGILQTVKVV<br>DELVKVMGRHKPENIVIEMARENQTTQKGQKNSRERMKRIEEGIKEL-<br>GSQILKEHPVENTQLQNEKLYLYYLQNGRDMYVDQELDINRLSDYD<br>VDHIVPQSFLKDDSIDNKVLTRSDKNRGKSDNVPSEEVVKKMKNYWRQLLNAK-<br>LITQRKFDNLTKAERGGLSELDKAGFIKRQLVETRQITKH<br>VAQILDSRMNIKYDENDKLIREVKVITLKSKLVSDFRKDFQFYKVREINNYHHAHDAYL-<br>NAVVGTALIKKYPKLESEFVYGDYKVYDVRKMIA<br>KSEQEIGKATAKYFFYSNIMNFFKTEITLANGEIRKRPLIETNGETGEIVWDKGRDFA-<br>TVRKVLSMPQVNIVKKTEVQTGGFSKESILPKRNS<br>DKLIARKKDWDPKKYGGFDSPTVAYSVLVVAKVEKGKSKKLKSVKELLGITIMERSS-<br>FEKNPIDFLEAKGYKEVKKDLIIKLPKYSLFELENG<br>RKRMLASAGELQKGNELALPSKYVNFLYLASHYEKLKGSPEDNEQKQLFVEQHKYHL-<br>DEIIEQISEFSKRVILADANLDKVLSAYNKHRDKPI<br>REQAENIIHLFTLTNLGAPAAFKYFDTTIDRKRYISTKEVLDATLIHQSITGLYETRIDLSQLGGDGGGSPKKKRKV | 6 |
| Cas9<br>nickase<br>(D10A)<br>mRNA<br>ORF | AUGGACAAGAAGUACAGCAUCGGACUGGCAAUCGGAACAAACAGCGUCGGAUGGGCAGU-<br>CAUCACAGACGAAUACAAGGUCCCGAGCAAGAAG<br>UUCAAGGUCCUGGGAAACACAGACAGACACAGCAUCAAGAAGAACCUGAUCGGAGCA-<br>CUGCUGUUCGACAGCGGAGAAACAGCAGAAGCAACA<br>AGACUGAAGAGAACAGCAAGAAGAAGAUACACAAGAAGAAGAACAGAAUCUGCUAC-<br>CUGCAGGAAAUCUUCAGCAACGAAAUGGCAAAGGUC<br>GACGACAGCUUCUUCCACAGACUGGAAGAAAGCUUCCUGGUCGAAGAA-<br>GACAAGAAGCACGAAAGACACCCGAUCUUCGGAAACAUCGUCGAC<br>GAAGUCGCAUACCACGAAAAGUACCCCGACAAUCUACCACCUGAGAAAGAAGCUGGU-<br>CGACAGCACAGACAAGGCAGACCUGAGACUGAUCUAC<br>CUGGCACUGGCACACAUGAUCAAGUUCAGAGGACACUUCCUGAUCGAAGGAGAC-<br>CUGAACCCGGACAACAGCGACGUCGACAAGCUGUUCAUC<br>CAGCUGGUCCAGACAUACAACCAGCUGUUCGAAGAAAACCCGAUCAACGCAAGCGGAGU-<br>CGACGCAAAGGCAAUCCUGAGCGCAAGACUGAGC<br>AAGAGCAGAAGACUGGAAAACCUGAUCGCACAGCUGCCGGGAGAAAAGAAGAACGGACU-<br>GUUCGGAAACCUGAUCGCACUGAGCCUGGGACUG<br>ACACCGAACUUCAAGAGCAACUUCGACCUGGCAGAA-<br>GACGCAAAGCUGCAGCUGAGCAAGGACACAUACGACGACGACCUGGACAACCUGCUG<br>GCACAGAUCGGAGACCAGUACGCAGACCUGUUCCUGGCAGCAAAGAAC-<br>CUGAGCGACGCAAUCCUGCUGAGCGACAUCCUGAGAGUCAACACA<br>GAAAUCACAAAGGCACCGCUGAGCGCAAGCAUGAUCAAGAGAUACGACGAACAC-<br>CACCAGGACCUGACACUGCUGAAGGCACUGGUCAGACAG<br>CAGCUGCCGGAAAAGUACAAGGAAAUCUUCUUCGACCAGAGCAAGAACGGAUACGCAG-<br>GAUACAUCGACGGAGGAGCAAGCCAGGAAGAAUUC<br>UACAAGUUCAUCAAGCCGAUCCUGGAAAAGAUGGACGGAACAGAAGAACUGCUGGU-<br>CAAGCUGAACAGAGAAGACCUGCUGAGAAAGCAGAGA<br>ACAUUCGACAACGGAAGCAUCCCGCACCAGAUCCACCUGGGAGAACUGCACGCAAUC-<br>CUGAGAAGACAGGAAGACUUCUACCCGUUCCUGAAG<br>GACAACAGAGAAAAGAUCGAAAAGAUCCUGACAUUCAGAAUCCCGUACUACGU-<br>CGGACCGCUGGCAAGAGGAAACAGCAGAUUCGCAUGGAUG | 7 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | ACAAGAAAGAGCGAAGAAACAAUCACACCGUGGAACUUCGAAGAAGUCGUCGACAAGG-<br>GAGCAAGCGCACAGAGCUUCAUCGAAAGAAUGACA<br>AACUUCGACAAGAACCUGCCGAACGAAAAGGUCCUGCCGAAGCACAGCCUGCU-<br>GUACGAAUACUUCACAGUCUACAACGAACUGACAAAGGUC<br>AAGUACGUCACAGAAGGAAUGAGAAAGCCGGCAUUCCUGAGCG-<br>GAGAACAGAAGAAGGCAAUCGUCGACCUGCUGUUCAAGACAAACAGAAAG<br>GUCACAGUCAAGCAGCUGAAGGAAGACUACUUCAAGAAGAUCGAAUGCUUCGACAGCGU-<br>CGAAAUCAGCGGAGUCGAAGACAGAUUCAACGCA<br>AGCCUGGGAACAUACCACGACCUGCUGAAGAUCAUCAAGGACAAGGACUUC-<br>CUGGACAACGAAGAAAACGAAGACAUCCUGGAAGACAUCGUC<br>CUGACACUGACACUGUUCGAAGACAGAGAAAUGAUCGAAGAAAGACUGAAGA-<br>CAUACGCACACCUGUUCGACGACAAGGUCAUGAAGCAGCUG<br>AAGAGAAGAAGAUACACAGGAUGGGGAAGACUGAGCAGAAAGCUGAUCAACGGAAUCAGA-<br>GACAAGCAGAGCGGAAAGACAAUCCUGGACUUC<br>CUGAAGAGCGACGGAUUCGCAAACAGAAACUUCAUGCAGCUGAUCCACGACGACAGC-<br>CUGACAUUCAAGGAAGACAUCCAGAAGGCACAGGUC<br>AGCGGACAGGGAGACAGCCUGCACGAACACAUCGCAAACCUGGCAGGAAGCCCGGCAAU-<br>CAAGAAGGGAAUCCUGCAGACAGUCAAGGUCGUC<br>GACGAACUGGUCAAGGUCAUGGGAAGACAAGCCGAAAACAUCGU-<br>CAUCGAAAUGGCAAGAGAAAACCAGACAACACAGAAGGGACAGAAG<br>AACAGCAGAGAAAGAAUGAAGAGAAUCGAAGAAGGAAUCAAGGAACUGGGAAGCCAGAUC-<br>CUGAAGGAACACCCGGUCGAAAACACACAGCUG<br>CAGAACGAAAAGCUGUACCUGUACUACCUGCAGAACGGAAGAGACAUGUACGUCGACCAG-<br>GAACUGGACAUCAACAGACUGAGCGACUACGAC<br>GUCGACCACAUCGUCCCGCAGAGCUUCCUGAAGGACGACAGCAUCGACAACAAGGUC-<br>CUGACAAGAAGCGACAAGAACAGAGGAAAGAGCGAC<br>AACGUCCCGAGCGAAGAAGUCGUCAAGAAGAUGAAGAACUACUGGA-<br>GACAGCUGCUGAACGCAAAGCUGAUCACACAGAGAAAGUUCGACAAC<br>CUGACAAAGGCAGAGAGGAGGACUGAGCGAACUGGACAAGGCAGGAUUCAUCAAGA-<br>GACAGCUGGUCGAAACAAGACAGAUCACAAAGCAC<br>GUCGCACAGAUCCUGGACAGCAGAAUGAACACAA-<br>AGUACGACGAAAACGACAAGCUGAUCAGAGAAGUCAAGGUCAUCACACUGAAGAGCAAG<br>CUGGUCAGCGACUUCAGAAAGGACUUCCAGUUCUACAAGGUCAGAGAAAUCAACAACUAC-<br>CACCACGCACACGACGCAUACCUGAACGCAGUC<br>GUCGGAACAGCACUGAUCAAGAAGUACCCGAAGCUGGAAAGCGAAUUCGUCUACGGAGAC-<br>UACAAGGUCUACGACGUCAGAAAGAUGAUCGCA<br>AAGAGCGAACAGGAAAUCGGAAAGGCAACAGCAAAGUACUUCUUCUACAGCAACAU-<br>CAUGAACUUCUUCAAGACAGAAAUCACACUGGCAAAC<br>GGAGAAAUCAGAAAGAGACCGCUGAUCGAAACAAACGGAGAAACAGGAGAAAUCGU-<br>CUGGGACAAGGGAAGAGACUUCGCAACAGUCAGAAAG<br>GUCCUGAGCAUGCCGCAGGUCAACAUCGUCAAGAAGACAGAAGUCCAGACAGGAG-<br>GAUUCAGCAAGGAAAGCAUCCUGCCGAAGAGAAACAGC<br>GACAAGCUGAUCGCAAGAAAGAAGGACUGGGACCCGAAGAAGUACGGAG-<br>GAUUCGACAGCCCGACAGUCGCAUACAGCGUCCUGGUCGUCGCA<br>AAGGUCGAAAAGGGAAAGAGCAAGAAGCUGAAGAGCGUCAAGGAACUGCUGGGAAU-<br>CACAAUCAUGGAAAGAAGCAGCUUCGAAAAGAACCCG<br>AUCGACUUCCUGGAAGCAAAGGGAUACAAGGAAGUCAAGAAGGACCUGAUCAU-<br>CAAGCUGCCGAAGUACAGCCUGUUCGAACUGGAAAACGGA<br>AGAAAGAGAAUGCUGGCAAGCGCAGGAGAACUGCAGAAGGGAAACGAACUGGCA-<br>CUGCCGAGCAAGUACGUCAACUUCCUGUACCUGGCAAGC<br>CACUACGAAAAGCUGAAGGGAAGCCCGGAAGACAACGAACAGAAGCAGCUGUUCGU-<br>CGAACAGCACAAGCACUACCUGGACGAAAUCAUCGAA<br>CAGAUCAGCGAAUUCAGCAAGAGAGUCAUCCUGGCAGACGCAAACCUGGACAAGGUC-<br>CUGAGCGCAUACAACAAGCACAGAGACAAGCCGAUC<br>AGAGAACAGGCAGAAAACAUCAUCCACCUGUUCACACUGACAAACCUGG-<br>GAGCACCGGCAGCAUUCAAGUACUUCGACACAACAAUCGACAGA<br>AAGAGAUACACAAGCACAAAGGAAGUCCUGGACGCAACACUGAUCCACCAGAGCAU-<br>CACAGGACUGUACGAAACAAGAAUCGACCUGAGCCAG<br>CUGGGAGGAGACGGAGGAGGAAGCCCGAAGAAGAAGAGAAAGGUCUAG | |
| dCas9 (D10A H840A) amino acid sequence | MDKKYSIGLAIGTNSVGWAVITDEYKVPSKKFKVLGNIDRHSIKKNLIGALLFDSGETAE-<br>ATRLKRTARRRYTRRKNRICYLQEIFSNEMAKV<br>DDSFFHRLEESFLVEEDKKHERHPIFGNIVDEVAYHEKYPTIYHLRKKLVD-<br>STDKADLRLIYLALAHMIKFRGHFLIEGDLNPDNSDVDKLFI<br>QLVQTYNQLFEENPINASGVDAKAILSARLSKSRRLENLIAQLPGEKKNGLFGNLIA-<br>LSLGLGLIPNFKSNFDLAEDAKLQLSKDTYDDDLDNLL<br>AQIGDQYADLFLAAKNLSDAILLSDILRVNTEITKAPLSASMIKRYDEHHQDLTLLKA-<br>LVRQQLPEKYKEIFFDQSKNGYAGYIDGGASQEEF<br>YKFIKPILEKMDGTEELLVKLNREDLLRKQRTFDNGSIPHQIHLGELHAILRRQEDFYP-<br>FLKDNREKIEKILTFRIPYYVGPLARGNSRFAWM<br>TRKSEETITPWNFEEVVDKGASAQSFIERMINFDKNLPNEKVLPKHSLLY-<br>EYFTVYNELTKVKYVTEGMRKPAFLSGEQKKAIVDLLFKTNRK<br>VTVKQLKEDYFKKIECFDSVEISGVEDRFNASLGTYHDLLKIIKDKDFLDNEENEDILE-<br>DIVLILTLFEDREMIEERLKTYAHLFDDKVMKQL<br>KRRRYTGWGRLSRKLINGIRDKQSGKTILDFLKSDGFANRNFMQLIHDD-<br>SLIFKEDIQKAQVSGQGDSLHEHIANLAGSPAIKKGILQTVKVV | 8 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | DELVKVMGRHKPENIVIEMARENQTTQKGQKNSRERMKRIEEGIKEL-GSQILKEHPVENTQLQNEKLYLYYLQNGRDMYVDQELDINRLSDYD VDAIVPQSFLKDDSIDNKVLIRSDKNRGKSDNVPSEEVVKKMKNYWRQLLNAK-LITQRKEDNLIKAERGGLSELDKAGFIKRQLVETRQITKH VAQILDSRMNIKYDENDKLIREVKVITLKSKLVSDFRKDFQFYKVREINNYHHAHDAYL-NAVVGTALIKKYPKLESEFVYGDYKVYDVRKMIA KSEQEIGKATAKYFFYSNIMNFFKTEITLANGEIRKRPLIETNGETGEIVWDKGRDFA-TVRKVLSMPQVNIVKKTEVQTGGFSKESILPKRNS DKLIARKKDWDPKKYGGFDSPTVAYSVLVVAKVEKGKSKKLKSVKELLGITIMERSS-FEKNPIDFLEAKGYKEVKKDLIIKLPKYSLFELENG RKRMLASAGELQKGNELALPSKYVNFLYLASHYEKLKGSPEDNEQKQLFVEQHKHYL-DEIIEQISEFSKRVILADANLDKVLSAYNKHRDKPI REQAENIIHLFTLINLGAPAAFKYFDTTIDRKRYISTKEVLDATLIHQSITGLYETRIDLSQLGGDGGGSPKKKRKV | |
| dCas9 (D10A H840A) mRNA ORF | AUGGACAAGAAGUACAGCAUCGGACUGGCAAUCGGAACAAACAGCGUCGGAUGGGCAGU-CAUCACAGACGAAUACAAGGUCCCGAGCAAGAAG UUCAAGGUCCUGGGAAACACAGACAGACACAGCAUCAAGAAGAACCUGAUCGGAGCA-CUGCUGUUCGACAGCGGAGAAACAGCAGAAGCAACA AGACUGAAGAGAACAGCAAGAAGAAGAUACACAAGAAGAAAGAACAGAAUCUGCUAC-CUGCAGGAAAUCUUCAGCAACGAAAUGGCAAAGGUC GACGACAGCUUCUUCCACAGACUGGAAGAAAGCUUCCUGGUCGAAGAA-GACAAGAAGCACGAAAGACACCCGAUCUUCGGAAACAUCGUCGAC GAAGUCGCAUACCACGAAAAGUACCCGACAAUCUACCACCUGAGAAAGAAGCUGGU-CGACAGCACAGACAAGGCAGACCUGAGACUGAUCUAC CUGGCACUGGCACACAUGAUCAAGUUCAGAGGACACUUCCUGAUCGAAGGAGAC-CUGAACCCGGACAACAGCGACGUCGACAAGCUGUUCAUC CAGCUGGUCCAGACAUACAACCAGCUGUUCGAAGAAAACCCGAUCAACGCAAGCGGAGU-CGACGCAAAGGCAAUCCUGAGCGCAAGACUGAGC AAGAGCAGAAGACUGGAAAACCUGAUCGCACAGCUGCCGGGAGAAAAGAAGAACGGACU-GUUCGGAAACCUGAUCGCACUGAGCCUGGGACUG ACACCGAACUUCAAGAGCAACUUCGACCUGGCAGAA-GACGCAAAGCUGCAGCUGAGCAAGGACACAUACGACGACGACCUGGACAACCUGCUG GCACAGAUCGGAGACCAGUACGCAGACCUGUUCCUGGCAGCAAAGAAC-CUGAGCGACGCAAUCCUGCUGAGCGACAUCCUGAGAGUCAACACA GAAAUCACAAAGGCACCGCUGAGCGCAAGCAUGAUCAAGAGAUACGACGAACAC-CACCAGGACCUGACACUGCUGAAGGCACUGGUCAGACAG CAGCUGCCGGAAAAGUACAAGGAAAUCUUCUUCGACCAGAGCAAGAACGGAUACGCAG-GAUACAUCGACGGAGGAGCAAGCCAGGAAGAAUUC UACAAGUUCAUCAAGCCCGAUCCUGGAAAAGAUGGACGGAACAGAAGAACUGCUGGU-CAAGCUGAACAGAGAAGACCUGCUGAGAAAGCAGAGA ACAUUCGACAACGGAAGCAUCCCGCACCAGAUCCACCUGGGAGAACUGCACGCAAUC-CUGAGAAGACAGGAAGACUUCUACCCGUUCCUGAAG GACAACAGAGAAAAGAUCGAAAAGAUCCUGACAUUCAGAAUCCCGUACUACGU-CGGACCGCUGGCAAGAGGAAACAGCAGAUUCGCAUGGAUG ACAAGAAAGAGCGAAGAAACAAUCACACCGUGGAACUUCGAAGAAGUCGUCGACAAGG-GAGCAAGCGCACAGAGCUUCAUCGAAAGAAUGACA AACUUCGACAAGAACCUGCCGAACGAAAAGGUCCUGCCGAAGCACAGCCUGCU-GUACGAAUACUUCACAGUCUACAACGAACUGACAAAGGUC AAGUACGUCACAGAAGGAAUGAGAAAGCCGGCAUUCCUGAGCG-GAGAACAGAAGAAGGCAAUCGUCGACCUGCUGUUCAAGACAAACAGAAAG GUCACAGUCAAGCAGCUGAAGGAAGACUACUUCAAGAAGAUCGAAUGCUUCGACAGCGU-CGAAAUCAGCGGAGUCGAAGACAGAUUCAACGCA AGCCUGGGAACAUACCACGACCUGCUGAAGAUCAUCAAGGACAAGGACUUC-CUGGACAACGAAGAAAACGAAGACAUCCUGGAAGACAUCGUC CUGACACUGACACUGUUCGAAGACAGAGAAAUGAUCGAAGAAGACUGAAGA-CAUACGCACACCUGUUCGACGACAAGGUCAUGAAGCAGCUG AAGAGAAGAAGAUACACAGGAUGGGGAAGACUGAGCAGAAAGCUGAUCAACGGAAUCAGA-GACAAGCAGAGCGGAAAAGACAAUCCUGGACUUC CUGAAGAGCGACGGAUUCGCAAACAGAAACUUCAUGCAGCUGAUCCACGACGACAGC-CUGACAUUCAAGGAAGACAUCCAGAAGGCACAGGUC AGCGGACAGGGAGACAGCCUGCACGAACACAUCGCAAACCUGGCAGGAAGCCCGGCAAU-CAAGAAGGGAAUCCUGCAGACAGUCAAGGUCGUC GACGAACUGGUCAAGGUCAUGGGAAGACACAAGCCGGAAAACAUCGU-CAUCGAAAUGGCAAGAGAAAACCAGACAACACAGAAGGGACAGAAG AACAGCAGAGAAAUGAAGAGAAUCGAAGAAGGAAUCAAGGAACUGGGAAGCCAGAUC-CUGAAGGAACACCCGGUCGAAAACACACAGCUG CAGAACGAAAAGCUGUACCUGUACUACCUGCAGAACGGAAGAGACAUGUACGUCGACCAG-GAACUGGACAUCAACAGACUGAGCGACUACGAC GUCGACGCAAUCGUCCCGCAGAGCUUCCUGAAGGACGACAGCAUCGACAACAAGGUC-CUGACAAGAAGCGACAAGAACAGAGGAAAGAGCGAC AACGUCCCGAGCGAAGAAGUCGUCAAGAAGAUGAAGAACUACUGGA-GACAGCUGCUGAACGCAAAGCUGAUCACACAGAGAAAGUUCGACAAC CUGACAAAGGCAGAGAGGAGGACUGAGCGAACUGGACAAGGCAGGAUUCAUCAAGA-GACAGCUGGUCGAAACAAGACAGAUCACAAAGCAC GUCGCACAGAUCCUGGACAGCAGAAUGAACACAA-AGUACGACGAAAACGACAAGCUGAUCAGAGAAGUCAAGGUCAUCACACUGAAGAGCAAG | 9 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | CUGGUCAGCGACUUCAGAAAGGACUUCCAGUUCUACAAGGUCAGAGAAAUCAACAACUAC-CACCACGCACACGACGCAUACCUGAACGCAGUC GUCGGAACAGCACUGAUCAAGAAGUACCCGAAGCUGGAAAGCGAAUUCGUCUACGGAGAC-UACAAGGUCUACGACGUCAGAAAGAUGAUCGCA AAGAGCGAACAGGAAAUCGGAAAGGCAACAGCAAAGUACUUCUUCUACAGCAACAU-CAUGAACUUCUUCAAGACAGAAAUCACACUGGCAAAC GGAGAAAUCAGAAAGAGACCGCUGAUCGAAACAAACGGAGAAACAGGAGAAAUCGU-CUGGGACAAGGGAAGAGACUUCGCAACAGUCAGAAAG GUCCUGAGCAUGCCGCAGGUCAACAUCGUCAAGAAGACAGAAGUCCAGCAGGAG-GAUUCAGCAAGGAAAGCAUCCUGCCGAAGAGAAACAGC GACAAGCUGAUCGCAAGAAAGAAGGACUGGGACCCGAAGAAGUACGGAG-GAUUCGACAGCCCGACAGUCGCAUACAGCGUCCUGGUCGUCGCA AAGGUCGAAAAGGGAAAGAGCAAGAAGCUGAAGAGCGUCAAGGAACUGCUGGGAAU-CACAAUCAUGGAAAGAAGCAGCUUCGAAAAGAACCCG AUCGACUUCCUGGAAGCAAAGGGAUAAGGAAGUCAAGAAGGACCUGAUCAU-CAAGCUGCCGAAGUACAGCCUGUUCGAACUGGAAAACGGA AGAAAGAGAAUGCUGGCAAGCGCAGGAGAACUGCAGAAGGGAAACGAACUGGCA-CUGCCGAGCAAGUACGUCAACUUCCUGUACCUGGCAAGC CACUACGAAAAGCUGAAGGGAAGCCCGGAAGACAACGAACAGAAGCAGCUGUUCGU-CGAACAGCACAAGCACUACCUGGACGAAAUCAUCGAA CAGAUCAGCGAAUUCAGCAAGAGAGUCAUCCUGGCAGACGCAAACCUGGACAAGGUC-CUGAGCGCAUACAACAAGCACAGAGACAAGCCGAUC AGAGAACAGGCAGAAAACAUCAUCCACCUGUUCACACUGACAAACCUGG-GAGCACCGGCAGCAUUCAAGUACUUCGACACAACAAUCGACAGA AAGAGAUACACAAGCACAAAGGAAGUCCUGGACGCAACACUGAUCCACCAGAGCAU-CACAGGACUGUACGAAACAAGAAUCGACCUGAGCCAG CUGGGAGGAGACGGAGGAGGAAGCCCGAAGAAGAAGAGAAAGGUCUAG | |
| Cas9 bare coding sequence | GACAAGAAGUACAGCAUCGGACUGGACAUCGGAACAAACAGCGUCGGAUGGGCAGUCAU-CACAGACGAAUACAAGGUCCCGAGCAAGAAGUUC AAGGUCCUGGGAAACACAGACAGACACAGCAUCAAGAAGAACCUGAUCGGAGCACUGCU-GUUCGACAGCGGAGAAACAGCAGAAGCAACAAGA CUGAAGAGAACAGCAAGAAGAAGAUACACAAGAAGAAAGAACAGAAUCUGCUACCUGCAG-GAAAUCUUCAGCAACGAAAUGGCAAAGGUCGAC GACAGCUUCUUCCACAGACUGGAAGAAAGCUUCCUGGUCGAAGAA-GACAAGAAGCACGAAAGACACCCGAUCUUCGAAACAUCGUCGACGAA GUCGCAUACCACGAAAAGUACCCGACAAUCUACCACCUGAGAAAGAAGCUGGU-CGACAGCACAGACAAGGCAGACCUGAGACUGAUCUACCUG GCACUGGCACACAUGAUCAAGUUCAGAGGACACUUCCUGAUCGAAGGAGAC-CUGAACCCGGACAACAGCGACGUCGACAAGCUGUUCAUCCAG CUGGUCCAGACAUACAACCAGCUGUUCGAAGAAAACCCGAUCAACGCAAGCGGAGU-CGACGCAAAGGCAAUCCUGAGCGCAAGACUGAGCAAG AGCAGAAGACUGGAAAACCUGAUCGCACAGCUGCCGGGAGAAAAGAAGAACGGACU-GUUCGGAAACCUGAUCGCACUGAGCCUGGGACUGACA CCGAACUUCAAGAGCAACUUCGACCUGGCAGAA-GACGCAAAGCUGCAGCUGAGCAAGGACACAUACGACGACGACCUGGACAACCUGCUGGCA CAGAUCGGAGACCAGUACGCAGACCUGUUCCUGGCAGCAAAGAACCUGAGCGACGCAAUC-CUGCUGAGCGACAUCCUGAGAGUCAACACAGAA AUCACAAAGGCACCGCUGAGCGCAAGCAUGAUCAAGAGAUACGACGAACACCACCAGGAC-CUGACACUGCUGAAGGCACUGGUCAGACAGCAG CUGCCGGAAAAGUACAAGGAAAUCUUCUUCGACCAGAGCAAGAACGGAUACGCAGGAUA-CAUCGACGGAGGAGCAAGCCAGGAAGAAUUCUAC AAGUUCAUCAAGCCGAUCCUGGAAAAGAUGGACGGAACAGAAGAACUGCUGGU-CAAGCUGAACAGAGAAGACCUGCUGAGAAAGCAGAGAACA UUCGACAACGGAAGCAUCCCGCACCAGAUCCACCUGGGAGAACUGCACGCAAUC-CUGAGAAGACAGGAAGACUUCUACCCGUUCCUGAAGGAC AACAGAGAAAAGAUCGAAAAGAUCCUGACAUUCAGAAUCCCGUACUACGU-CGGACCGCUGGCAAGAGGAAACAGCAGAUUCGCAUGGAUGACA AGAAAGAGCGAAGAAACAAUCACACCGUGGAACUUCGAAGAAGUCGUCGACAAGG-GAGCAAGCGCACAGAGCUUCAUCGAAAGAAUGACAAAC UUCGACAAGAACCUGCCGAACGAAAAGGUCCUGCCGAAGCACAGCCUGCUGUACGAAUAC-UUCACAGUCUACAACGAACUGACAAAGGUCAAG UACGUCACAGAAGGAAUGAGAAAGCCGGCAUUCCUGAGCGGAGAACAGAAGAAGGCAAUC-GUCGACCUGCUGUUCAAGACAAACAGAAAGGUC ACAGUCAAGCAGCUGAAGGAAGACUACUUCAAGAAGAUCGAAUGCUUCGACAGCGU-CGAAAUCAGCGGAGUCGAAGACAGAUUCAACGCAAGC CUGGGAACAUACCACGACCUGCUGAAGAUCAUCAAGGACAAGGACUUC-CUGGACAACGAAGAAAACGAAGACAUCCUGGAAGACAUCGUCCUG ACACUGACACUGUUCGAAGACAGAGAAAUGAUCGAAGAAAGACUGAAGACAUACGCACAC-CUGUUCGACGACAAGGUCAUGAAGCAGCUGAAG AGAAGAAGAUACACAGGAUGGGGAAGACUGAGCAGAAAGCUGAUCAACGGAAUCAGA-GACAAGCAGAGCGGAAAGACAAUCCUGGACUUCCUG AAGAGCGACGGAUUCGCAAACAGAAACUUCAUGCAGCUGAUCCACGACGACAGCCUGA-CAUUCAAGGAAGACAUCCAGAAGGCACAGGUCAGC GGACAGGGAGACAGCCUGCACGAACACAUCGCAAACCUGGCAGGAAGCCCGGCAAUC-AAGAAGGGAAUCCUGCAGACAGUCAAGGUCGUCGAC | 10 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | GAACUGGUCAAGGUCAUGGGAAGACACAAGCCGGAAAACAUCGU-CAUCGAAAUGGCAAGAGAAAACCAGACAACACAGAAGGGACAGAAGAAC AGCAGAGAAAGAAUGAAGAGAAUCGAAGAAGGAAUCAAGGAACUGGGAAGCCAGAUC-CUGAAGGAACACCCGGUCGAAAACACACAGCUGCAG AACGAAAAGCUGUACCUGUACUACCUGCAGAACGGAAGAGACAUGUACGUCGACCAG-GAACUGGACAUCAACAGACUGAGCGACUACGACGUC GACCACAUCGUCCCGCAGAGCUUCCUGAAGGACGACAGCAUCGACAACAAGGUC-CUGACAAGAAGCGACAAGAACAGAGGAAAGAGCGACAAC GUCCCGAGCGAAGAAGUCGUCAAGAAGAUGAAGAACUACUGGA-GACAGCUGCUGAACGCAAAGCUGAUCACACAGAGAAAGUUCGACAACCUG ACAAAGGCAGAGAGGAGGACUGAGCGAACUGGACAAGGCAGGAUUCAUCAAGA-GACAGCUGGUCGAAACAAGACAGAUCACAAAGCACGUC GCACAGAUCCUGGACAGCAGAAUGAACACAA-AGUACGACGAAAACGACAAGCUGAUCAGAGAAGUCAAGGUCAUCACACUGAAGAGCAAGCUG GUCAGCGACUUCAGAAAGGACUUCCAGUUCUACAAGGUCAGAGAAAUCAACAACUACCAC-CACGCACACGACGCAUACCUGAACGCAGUCGUC GGAACAGCACUGAUCAAGAAGUACCCGAAGCUGGAAAAGCGAAUUCGUCUACGGAGACUA-CAAGGUCUACGACGUCAGAAAGAUGAUCGCAAAG AGCGAACAGGAAAUCGGAAAGGCAACAGCAAAGUACUUCUUCUACAGCAACAUCAUGAAC-UUCUUCAAGACAGAAAUCACACUGGCAAACGGA GAAAUCAGAAAGAGACCGCUGAUCGAAACAAACGGAGAAACAGGAGAAAUCGU-CUGGGACAAGGGAAGAGACUUCGCAACAGUCAGAAAGGUC CUGAGCAUGCCGCAGGUCAACAUCGUCAAGAAGACAGAAGUCCAGACAGGAG-GAUUCAGCAAGGAAAGCAUCCUGCCGAAGAGAAACAGCGAC AAGCUGAUCGCAAGAAAGAAGGACUGGGACCCGAAGAAGUACGGAG-GAUUCGACAGCCCGACAGUCGCAUACAGCGUCCUGGUCGUCGCAAAG GUCGAAAAGGGAAAGAGCAAGAAGCUGAAGAGCGUCAAGGAACUGCUGGGAAUCACAAU-CAUGGAAAGAAGCAGCUUCGAAAAGAACCCGAUC GACUUCCUGGAAGCAAAGGGAUACAAGGAAGUCAAGAAGGACCUGAUCAU-CAAGCUGCCGAAGUACAGCCUGUUCGAACUGGAAAACGGAAGA AAGAGAAUGCUGGCAAGCGCAGGAGAACUGCAGAAGGGAAACGAACUGGCA-CUGCCGAGCAAGUACGUCAACUUCCUGUACCUGGCAAGCCAC UACGAAAAGCUGAAGGGAAGCCCGGAAGACAACGAACAGAAGCAGCUGUUCGU-CGAACAGCACAAGCACUACCUGGACGAAAUCAUCGAACAG AUCAGCGAAUUCAGCAAGAGAGUCAUCCUGGCAGACGCAAAACCUGGACAAGGUC-CUGAGCGCAUACAACAAGCACAGAGACAAGCCGAUCAGA GAACAGGCAGAAAACAUCAUCCACCUGUUCACACUGACAAACCUGGGAGCACCGGCAG-CAUUCAAGUACUUCGACACAACAAUCGACAGAAAG AGAUACACAAGCACAAAGGAAGUCCUGGACGCAACACUGAUCCACCAGAGCAU-CACAGGACUGUACGAAACAAGAAUCGACCUGAGCCAGCUG GGAGGAGACGGAGGAGGAAGCCCGAAGAAGAAGAGAAAGGUC | |
| Cas9 nickase bare coding sequence | GACAAGAAGUACAGCAUCGGACUGGCAAUCGGAACAAACAGCGUCGGAUGGGCAGUCAU-CACAGACGAAUACAAGGUCCCGAGCAAGAAGUUC AAGGUCCUGGGAAACACAGACAGACACAGCAUCAAGAAGAACCUGAUCGGAGCACUGCU-GUUCGACAGCGGAGAAACAGCAGAAGCAACAAGA CUGAAGAGAACAGCAAGAAGAAGAUACACAAGAAGAAAGAACAGAAUCUGCUACCUGCAG-GAAAUCUUCAGCAACGAAAUGGCAAAGGUCGAC GACAGCUUCUUCCACAGACUGGAAGAAAGCUUCCUGGUCGAAGAA-GACAAGAAGCACGAAAGACACCCGAUCUUCGGAAACAUCGUCGACGAA GUCGCAUACCACGAAAAGUACCCGACAAUCUACCACCUGAGAAAGAAGCUGGU-CGACAGCACAGACAAGGCAGACCUGAGACUGAUCUACCUG GCACUGGCACACAUGAUCAAGUUCAGAGGACACUUCCUGAUCGAAGGAGAC-CUGAACCCGGACAACAGCGACGUCGACAAGCUGUUCAUCCAG CUGGUCCAGACAUACAACCAGCUGUUCGAAGAAAACCCGAUCAACGCAAGCGGAGU-CGACGCAAAGGCAAUCCUGAGCGCAAGACUGAGCAAG AGCAGAAGACUGGAAAACCUGAUCGCACAGCUGCCGGGAGAAAAGAAGAACGGACU-GUUCGGAAACCUGAUCGCACUGAGCCUGGGACUGACA CCGAACUUCAAGAGCAACUUCGACCUGGCAGAA-GACGCAAAGCUGCAGCUGAGCAAGGACACAUACGACGACGACCUGGACAACCUGCUGGCA CAGAUCGGAGACCAGUACGCAGACCUGUUCCUGGCAGCAAAGAACCUGAGCGACGCAAUC-CUGCUGAGCGACAUCCUGAGAGUCAACACAGAA AUCACAAAGGCACCGCUGAGCGCAAGCAUGAUCAAGAGAUACGACGAACACCACCAGGAC-CUGACACUGCUGAAGGCACUGGUCAGACAGCAG CUGCCGGAAAAGUACAAGGAAAUCUUCUUCGACCAGAGCAAGAACGGAUACGCAGGAUA-CAUCGACGGAGGAGCAAGCCAGGAAGAAUUCUAC AAGUUCAUCAAGCCGAUCCUGGAAAAGAUGGACGGAACAGAAGAACUGCUGGU-CAAGCUGAACAGAGAAGACCUGCUGAGAAAGCAGAGAACA UUCGACAACGGAAGCAUCCCGCACCAGAUCCACCUGGGAGAACUGCACGCAAUC-CUGAGAAGACAGGAAGACUUCUACCCGUUCCUGAAGGAC AACAGAGAAAAGAUCGAAAAGAUCCUGACAUUCAGAAUCCCGUACUACGU-CGGACCGCUGGCAAGAGGAAACAGCAGAUUCGCAUGGAUGACA AGAAAGAGCGAAGAAACAAUCACACCGUGGAACUUCGAAGAAGUCGUCGACAAGG-GAGCAAGCGCACAGAGCUUCAUCGAAAGAAUGACAAAC UUCGACAAGAACCUGCCGAACGAAAAGGUCCUGCCGAAGCACAGCCUGCUGUACGAAUAC-UUCACAGUCUACAACGAACUGACAAAGGUCAAG | 11 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | UACGUCACAGAAGGAAUGAGAAAGCCGGCAUUCCUGAGCGGAGAACAGAAGAAGGCAAUC-GUCGACCUGCUGUUCAAGACAAACAGAAAGGUC ACAGUCAAGCAGCUGAAGGAAGACUACUUCAAGAAGAUCGAAUGCUUCGACAGCGU-CGAAAUCAGCGGAGUCGAAGACAGAUUCAACGCAAGC CUGGGAACAUACCACGACCUGCUGAAGAUCAUCAAGGACAAGGACUUC-CUGGACAACGAAGAAAACGAAGACAUCCUGGAAGACAUCGUCCUG ACACUGACACUGUUCGAAGACAGAGAAAUGAUCGAAGAAAGACUGAAGACAUACGCACAC-CUGUUCGACGACAAGGUCAUGAAGCAGCUGAAG AGAAGAAGAUACACAGGAUGGGGAAGACUGAGCAGAAAGCUGAUCAACGGAAUCAGA-GACAAGCAGAGCGGAAAGACAAUCCUGGACUUCCUG AAGAGCGACGGAUUCGCAAACAGAAACUUCAUGCAGCUGAUCCACGACGACAGCCUGA-CAUUCAAGGAAGACAUCCAGAAGGCACAGGUCAGC GGACAGGGAGACAGCCUGCACGAACACAUCGCAAACCUGGCAGGAAGCCCGGCAAU-CAAGAAGGGAAUCCUGCAGACAGUCAAGGUCGUCGAC GAACUGGUCAAGGUCAUGGGAAGACACAAGCCGGAAAACAUCGU-CAUCGAAAUGGCAAGAGAAAACCAGACAACACAGAAGGGACAGAAGAAC AGCAGAGAAAGAAUGAAGAGAAUCGAAGAAGGAAUCAAGGAACUGGGAAGCCAGAUC-CUGAAGGAACACCCGGUCGAAAACACACAGCUGCAG AACGAAAAGCUGUACCUGUACUACCUGCAGAACGGAAGAGACAUGUACGUCGACCAG-GAACUGGACAUCAACAGACUGAGCGACUACGACGUC GACCACAUCGUCCCGCAGAGCUUCCUGAAGGACGACAGCAUCGACAACAAGGUC-CUGACAAGAAGCGACAAGAACAGAGGAAAGAGCGACAAC GUCCCGAGCGAAGAAGUCGUCAAGAAGAUGAAGAACUACUGGA-GACAGCUGCUGAACGCAAAGCUGAUCACACAGAGAAAGUUCGACAACCUG ACAAAGGCAGAGAGAGGAGGACUGAGCGAACUGGACAAGGCAGGAUUCAUCAAGA-GACAGCUGGUCGAAACAAGACAGAUCACAAAGCACGUC GCACAGAUCCUGGACAGCAGAAUGAACACAA-AGUACGACGAAAACGACAAGCUGAUCAGAGAAGUCAAGGUCAUCACACUGAAGAGCAAGCUG GUCAGCGACUUCAGAAAGGACUUCCAGUUCUACAAGGUCAGAGAAAUCAACAACUACCAC-CACGCACACGACGCAUACCUGAACGCAGUCGUC GGAACAGCACUGAUCAAGAAGUACCCGAAGCUGGAAAGCGAAUUCGUCUACGGAGACUA-CAAGGUCUACGACGUCAGAAAGAUGAUCGCAAAG AGCGAACAGGAAAUCGGAAAGGCAACAGCAAAGUACUUCUUCUACAGCAACAUCAUGAAC-UUCUUCAAGACAGAAAUCACACUGGCAAACGGA GAAAUCAGAAAGAGACCGCUGAUCGAAACAAACGGAGAAACAGGAGAAAUCGU-CUGGGACAAGGGAAGAGACUUCGCAACAGUCAGAAAGGUC CUGAGCAUGCCGCAGGUCAACAUCGUCAAGAAGACAGAAGUCCAGACAGGAG-GAUUCAGCAAGGAAAGCAUCCUGCCGAAGAGAAACAGCGAC AAGCUGAUCGCAAGAAAGAAGGACUGGGACCCGAAGAAGUACGGAG-GAUUCGACAGCCCGACAGUCGCAUACAGCGUCCUGGUCGUCGCAAAG GUCGAAAAGGGAAAGAGCAAGAAGCUGAAGAGCGUCAAGGAACUGCUGGGAAUCACAAU-CAUGGAAAGAAGCAGCUUCGAAAAGAACCCGAUC GACUUCCUGGAAGCAAAGGGAUACAAGGAAGUCAAGAAGGACCUGAUCAU-CAAGCUGCCGAAGUACAGCCUGUUCGAACUGGAAAACGGAAGA AAGAGAAUGCUGGCAAGCGCAGGAGAACUGCAGAAGGGAAACGAACUGGCA-CUGCCGAGCAAGUACGUCAACUUCCUGUACCUGGCAAGCCAC UACGAAAAGCUGAAGGGAAGCCCGGAAGACAACGAACAGAAGCAGCUGUUCGU-CGAACAGCACAAGCACUACCUGGACGAAAUCAUCGAACAG AUCAGCGAAUUCAGCAAGAGAGUCAUCCUGGCAGACGCAAACCUGGACAAGGUC-CUGAGCGCAUACAACAAGCACAGAGACAAGCCGAUCAGA GAACAGGCAGAAAACAUCAUCCACCUGUUCACACUGACAAACCUGGGAGCACCGGCAG-CAUUCAAGUACUUCGACACAACAAUCGACAGAAAG AGAUACACAAGCACAAAGGAAGUCCUGGACGCAACACUGAUCCACCAGAGCAU-CACAGGACUGUACGAAACAAGAAUCGACCUGAGCCAGCUG GGAGGAGACGGAGGAGGAAGCCCGAAGAAGAAGAGAAAGGUC | |
| dCas9 bare coding sequence | GACAAGAAGUACAGCAUCGGACUGGCAAUCGGAACAAACAGCGUCGGAUGGGCAGUCAU-CACAGACGAAUACAAGGUCCCGAGCAAGAAGUUC AAGGUCCUGGGAAACACAGACAGACACAGCAUCAAGAAGAACCUGAUCGGAGCACUGCU-GUUCGACAGCGGAGAAAGCAGCAGAAGCAACAAGA CUGAAGAGAACAGCAAGAAGAAGAUACACAAGAAGAAACAGAAUCUGCUACCUGCAG-GAAAUCUUCAGCAACGAAAUGGCAAAGGUCGAC GACAGCUUCUUCCACAGACUGGAAGAAAGCUUCCUGGUCGAAGAA-GACAAGAAGCACGAAAGACACCCGAUCUUCGGAAACAUCGUCGACGAA GUCGCAUACCACGAAAAGUACCCGACAAUCUACCACCUGAGAAAGAAGCUGGU-CGACAGCACAGACAAGGCAGACCUGAGACUGAUCUACCUG GCACUGGCACACAUGAUCAAGUUCAGAGGACACUUCCUGAUCGAAGGAGAC-CUGAACCCGGACAACAGCGACGUCGACAAGCUGUUCAUCCAG CUGGUCCAGACAUACAACCAGCUGUUCGAAGAAAACCCGAUCAACGCAAGCGGAGU-CGACGCAAAGGCAAUCCUGAGCGCAAGACUGAGCAAG AGCAGAAGACUGGAAAACCUGAUCGCACAGCUGCCGGGAGAAAAAGAAGAACGGACU-GUUCGGAAACCUGAUCGCACUGAGCCUGGGACUGACA CCGAACUUCAAGAGCAACUUCGACCUGGCAGAA-GACGCAAAGCUGCAGCUGAGCAAGGACACAUACGACGACGACCUGGACAACCUGCUGGCA CAGAUCGGAGACCAGUACGCAGACCUGUUCCUGGCAGCAAAGAACCUGAGCGACGCAAUC-CUGCUGAGCGACAUCCUGAGAGUCAACACAGAA | 12 |

-continued

Sequence Table
The following sequence table provides a listing of sequences disclosed herein. It is understood that if a DNA sequence (comprising Ts) is referenced with respect to an RNA, then Ts should be replaced with Us(which may be modified or unmodified depending on the context), and vice versa.

| Description | Sequence | SEQ ID No. |
|---|---|---|
| | AUCACAAAGGCACCGCUGAGCGCAAGCAUGAUCAAGAGAUACGACGAACACCACCAGGAC-CUGACACUGCUGAAGGCACUGGUCAGACAGCAG CUGCCGGAAAAGUACAAGGAAAUCUUCUUCGACCAGAGCAAGAACGGAUACGCAGGAUA-CAUCGACGGAGGAGCAAGCCAGGAAGAAUUCUAC AAGUUCAUCAAGCCGAUCCUGGAAAAGAUGGACGGAACAGAAGAACUGCUGGU-CAAGCUGAACAGAGAAGACCUGCUGAGAAAGCAGAGAACA UUCGACAACGGAAGCAUCCCGCACCAGAUCCACCUGGGAGAACUGCACGCAAUC-CUGAGAAGACAGGAAGACUUCUACCCGUUCCUGAAGGAC AACAGAGAAAAGAUCGAAAAGAUCCUGACAUUCAGAAUCCCGUACUACGU-CGGACCGCUGGCAAGAGGAAACAGCAGAUUCGCAUGGAUGACA AGAAAGAGCGAAGAAACAAUCACACCGUGGAACUUCGAAGAAGUCGUCGACAAGG-GAGCAAGCGCACAGAGCUUCAUCGAAAGAAUGACAAAC UUCGACAAGAACCUGCCGAACGAAAAGGUCCUGCCGAAGCACAGCCUGCUGUACGAAUAC-UUCACAGUCUACAACGAACUGACAAAGGUCAAG UACGUCACAGAAGGAAUGAGAAAGCCGGCAUUCCUGAGCGGAGAACAGAAGAAGGCAAUC-GUCGACCUGCUGUUCAAGACAAACAGAAAGGUC ACAGUCAAGCAGCUGAAGGAAGACUACUUCAAGAAGAUCGAAUGCUUCGACAGCGU-CGAAAUCAGCGGAGUCGAAGACAGAUUCAACGCAAGC CUGGGAACAUACCACGACCUGCUGAAGAUCAUCAAGGACAAGGACUUC-CUGGACAACGAAGAAAACGAAGACAUCCUGGAAGACAUCGUCCUG ACACUGACACUGUUCGAAGACAGAGAAAUGAUCGAAGAAAGACUGAAGACAUACGCACAC-CUGUUCGACGACAAGGUCAUGAAGCAGCUGAAG AGAAGAAGAUACACAGGAUGGGGAAGACUGAGCAGAAAGCUGAUCAACGGAAUCAGA-GACAAGCAGAGCGGAAAGACAAUCCUGGACUUCCUG AAGAGCGACGGAUUCGCAAACAGAAACUUCAUGCAGCUGAUCCACGACGACAGCCUGA-CAUUCAAGGAAGACAUCCAGAAGGCACAGGUCAGC GGACAGGGAGACAGCCUGCACGAACACAUCGCAAACCUGGCAGGAAGCCCGGCAAU-CAAGAAGGGAAUCCUGCAGACAGUCAAGGUCGUCGAC GAACUGGUCAAGGUCAUGGGAAGACACAAGCCGGAAAACAUCGU-CAUCGAAAUGGCAAGAGAAAACCAGACAACACAGAAGGGACAGAAGAAC AGCAGAGAAAGAAUGAAGAGAAUCGAAGAAGGAAUCAAGGAACUGGGAAGCCAGAUC-CUGAAGGAACACCCGGUCGAAAACACACAGCUGCAG AACGAAAAGCUGUACCUGUACUACCUGCAGAACGGAAGAGACAUGUACGUCGACCAG-GAACUGGACAUCAACAGACUGAGCGACUACGACGUC GACGCAAUCGUCCCGCAGAGCUUCCUGAAGGACGACAGCAUCGACAACAAGGUC-CUGACAAGAAGCGACAAGAACAGAGGAAAGAGCGACAAC GUCCCGAGCGAAGAAGUCGUCAAGAAGAUGAAGAACUACUGGA-GACAGCUGCUGAACGCAAAGCUGAUCACACAGAGAAAGUUCGACAACCUG ACAAAGGCAGAGAGGAGGACUGAGCGAACUGGACAAGGCAGGAUUCAUCAAGA-GACAGCUGGUCGAAACAAGACAGAUCACAAAGCACGUC GCACAGAUCCUGGACAGCAGAAUGAACACAA-AGUACGACGAAAACGACAAGCUGAUCAGAGAAGUCAAGGUCAUCACACUGAAGAGCAAGCUG GUCAGCGACUUCAGAAAGGACUUCCAGUUCUACAAGGUCAGAGAAAUCAACAACUACCAC-CACGCACACGACGCAUACCUGAACGCAGUCGUC GGAACAGCACUGAUCAAGAAGUACCCGAAGCUGGAAAGCGAAUUCGUCUACGGAGACUA-CAAGGUCUACGACGUCAGAAAGAUGAUCGCAAAG AGCGAACAGGAAAUCGGAAAGGCAACAGCAAAGUACUUCUUCUACAGCAACAUCAUGAAC-UUCUUCAAGACAGAAAUCACACUGGCAAACGGA GAAAUCAGAAAGAGACCGCUGAUCGAAACAAACGGAGAAACAGGAGAAAUCGU-CUGGGACAAGGGAAGAGACUUCGCAACAGUCAGAAAGGUC CUGAGCAUGCCGCAGGUCAACAUCGUCAAGAAGACAGAAGUCCAGACAGGAG-GAUUCAGCAAGGAAAGCAUCCUGCCGAAGAGAAACAGCGAC AAGCUGAUCGCAAGAAAGAAGGACUGGGACCCGAAGAAGUACGGAG-GAUUCGACAGCCCGACAGUCGCAUACAGCGUCCUGGUCGUCGCAAAG GUCGAAAAGGGAAAGAGCAAGAAGCUGAAGAGCGUCAAGGAACUGCUGGGAAUCACAAU-CAUGGAAAGAAGCAGCUUCGAAAAGAACCCGAUC GACUUCCUGGAAGCAAAGGGAUACAAGGAAGUCAAGAAGGACCUGAUCAU-CAAGCUGCCGAAGUACAGCCUGUUCGAACUGGAAAACGGAAGA AAGAGAAUGCUGGCAAGCGCAGGAGAACUGCAGAAGGGAAACGAACUGGCA-CUGCCGAGCAAGUACGUCAACUUCCUGUACCUGGCAAGCCAC UACGAAAAGCUGAAGGGAAGCCCGGAAGACAACGAACAGAAGCAGCUGUUCGU-CGAACAGCACAAGCACUACCUGGACGAAAUCAUCGAACAG AUCAGCGAAUUCAGCAAGAGAGUCAUCCUGGCAGACGCAAACCUGGACAAGGUC-CUGAGCGCAUACAACAAGCACAGAGACAAGCCGAUCAGA GAACAGGCAGAAAACAUCAUCCACCUGUUCACACUGACAAACCUGGGAGCACCGGCAG-CAUUCAAGUACUUCGACACAACAAUCGACAGAAAG AGAUACACAAGCACAAAGGAAGUCCUGGACGCAACACUGAUCCACCAGAGCAU-CACAGGACUGUACGAAACAAGAAUCGACCUGAGCCAGCUG GGAGGAGACGGAGGAGGAAGCCCGAAGAAGAAGAGAAAGGUC | |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| Amino acid sequence of Cas9 (without NLS) | MDKKYSIGLDIGTNSVGWAVITDEYKVPSKKFKVLGNTDRHSIKKNLIGALLFDSGETAE-ATRLKRTARRRYTRRKNRICYLQEIFSNEMAKV<br>DDSFFHRLEESFLVEEDKKHERHPIFGNIVDEVAYHEKYPTIYHLRKKLVD-STDKADLRLIYLALAHMIKFRGHFLIEGDLNPDNSDVDKLFI<br>QLVQTYNQLFEENPINASGVDAKAILSARLSKSRRLENLIAQLPGEKKNGLFGNLIA-LSLGLIPNFKSNFDLAEDAKLQLSKDTYDDDLDNLL<br>AQIGDQYADLFLAAKNLSDAILLSDILRVNTEITKAPLSASMIKRYDEHHQDLILLKA-LVRQQLPEKYKEIFFDQSKNGYAGYIDGGASQEEF<br>YKFIKPILEKMDGTEELLVKLNREDLLRKQRTFDNGSIPHQIHLGELHAILRRQEDFYP-FLKDNREKIEKILTFRIPYYVGPLARGNSRFAWM<br>TRKSEETITPWNFEEVVDKGASAQSFIERMINFDKNLPNEKVLPKHSLLY-EYFTVYNELTKVKYVTEGMRKPAFLSGEQKKAIVDLLFKTNRK<br>VTVKQLKEDYFKKIECFDSVEISGVEDRFNASLGTYHDLLKIIKDKDFLDNEENEDILE-DIVLTLTLFEDREMIEERLKTYAHLFDDKVMKQL<br>KRRRYTGWGRLSRKLINGIRDKQSGKTILDFLKSDGFANRNFMQLIHDD-SLIFKEDIQKAQVSGQGDSLHEHIANLAGSPAIKKGILQTVKVV<br>DELVKVMGRHKPENIVIEMARENQTTQKGQKNSRERMKRIEEGIKEL-GSQILKEHPVENTQLQNEKLYLYYLQNGRDMYVDQELDINRLSDYD<br>VDHIVPQSFLKDDSIDNKVLIRSDKNRGKSDNVPSEEVVKKMKNYWRQLLNAK-LITQRKFDNLIKAERGGLSELDKAGFIKRQLVETRQIIKH<br>VAQILDSRMNIKYDENDKLIREVKVITLKSKLVSDFRKDFQFYKVREINNYHHAHDAYL-NAVVGTALIKKYPKLESEFVYGDYKVYDVRKMIA<br>KSEQEIGKATAKYFFYSNIMNFFKTEITLANGEIRKRPLIETNGETGEIVWDKGRDFA-TVRKVLSMPQVNIVKKTEVQTGGFSKESILPKRNS<br>DKLIARKKDWDPKKYGGFDSPTVAYSVLVVAKVEKGKSKKLKSVKELLGITIMERSS-FEKNPIDFLEAKGYKEVKKDLIIKLPKYSLFELENG<br>RKRMLASAGELQKGNELALPSKYVNFLYLASHYEKLKGSPEDNEQKQLFVEQHKHYL-DEIIEQISEFSKRVILADANLDKVLSAYNKHRDKPI<br>REQAENIIHLFTLTNLGAPAAFKYFDTTIDRKRYTSTKEVLDATLIHQSITGLYETRIDLSQLGGD | 13 |
| Cas9 mRNA ORF encoding SEQ ID NO: 13 using minimal uridine codons as listed in Table 3, with start and stop codons | AUGGACAAGAAGUACAGCAUCGGACUGGACAUCGGAACAAACAGCGUCGGAUGGGCAGU-CAUCACAGACGAAUACAAGGUCCCGAGCAAGAAG<br>UUCAAGGUCCUGGGAAACACAGACAGACACAGCAUCAAGAAGAACCUGAUCGGAGCA-CUGCUGUUCGACAGCGGAGAAACAGCAGAAGCAACA<br>AGACUGAAGAGAACAGCAAGAAGAAGAUACAAGAAGAAAGAACAGAAUCUGCUAC-CUGCAGGAAAUCUUCAGCAACGAAAUGGCAAAGGUC<br>GACGACAGCUUCUUCCACAGACUGGAAGAAAGCUUCCUGGUCGAAGAA-GACAAGAAGCACGAAAGACACCCGAUCUUCGGAAACAUCGUCGAC<br>GAAGUCGCAUACCACGAAAAGUACCCGACAAUCUACCACCUGAGAAAGAAGCUGGU-CGACAGCACAGACAAGGCAGACCUGAGACUGAUCUAC<br>CUGGCACUGGCACACAUGAUCAAGUUCAGAGGACACUUCCUGAUCGAAGGAGAC-CUGAACCCGGACAACAGCGACGUCGACAAGCUGUUCAUC<br>CAGCUGGUCCAGACAUACAACCAGCUGUUCGAAGAAAACCCGAUCAACGCAAGCGGAGU-CGACGCAAAGGCAAUCCUGAGCGCAAGACUGAGC<br>AAGAGCAGAAGACUGGAAAACCUGAUCGCACAGCUGCCGGGAGAAAAGAAGAACGGACU-GUUCGGAAACCUGAUCGCACUGAGCCUGGGACUG<br>ACACCGAACUUCAAGAGCAACUUCGACCUGGCAGAA-GACGCAAAGCUGCAGCUGAGCAAGGACACAUACGACGACGACCUGGACAACCUGCUG<br>GCACAGAUCGGAGACCAGUACGCAGACCUGUUCCUGGCAGCAAAGAAC-CUGAGCGACGCAAUCCUGCUGAGCGACAUCCUGAGAGUCAACACA<br>GAAAUCACAAAGGCACCGCUGAGCGCAAGCAUGAUCAAGAGAUACGACGAACAC-CACCAGGACCUGACACUGCUGAAGGCACUGGUCAGACAG<br>CAGCUGCCGGAAAAGUACAAGGAAAUCUUCUUCGACCAGAGCAAGAACGGAUACGCAG-GAUACAUCGACGGAGGAGCAAGCCAGGAAGAAUUC<br>UACAAGUUCAUCAAGCCGAUCCUGGAAAAGAUGGACGGAACAGAAGAACUGCUGGU-CAAGCUGAACAGAGAAGACCUGCUGAGAAAGCAGAGA<br>ACAUUCGACAACGGAAGCAUCCCGCACCAGAUCCACCUGGGAGAACUGCACGCAAUC-CUGAGAAGACAGGAAGACUUCUACCCGUUCCUGAAG<br>GACAACAGAGAAAAGAUCGAAAAGAUCCUGACAUUCAGAAUCCCGUACUACGU-CGGACCGCUGGCAAGAGGAAACAGCAGAUUCGCAUGGAUG<br>ACAAGAAGAGCGAAGAACAUCACACCGUGGAACUUCGAAGAAGUCGUCGACAAGG-GAGCAAGCGCACAGAGCUUCAUCGAAAGAAUGACA<br>AACUUCGACAAGAACCUGCCGAACGAAAAGGUCCUGCCGAAGCACAGCCUGCU-GUACGAAUACUUCACAGUCUACAACGAACUGACAAAGGUC<br>AAGUACGUCACAGAAGGAAUGAGAAAGCCGGCAUUCCUGAGCG-GAGAACAGAAGAAGGCAAUCGUCGACCUGCUGUUCAAGACAAACAGAAAG<br>GUCACAGUCAAGCAGCUGAAGGAAGACUACUUCAAGAAGAUCGAAUGCUUCGACAGCGU-CGAAAUCAGCGGAGUCGAAGACAGAUUCAACGCA<br>AGCCUGGGAACAUACCACGACCUGCUGAAGAUCAUCAAGGACAAGGACUUC-CUGGACAACGAAGAAAACGAAGACAUCCUGGAAGACAUCGUC<br>CUGACACUGACACUGUUCGAAGACAGAGAAAUGAUCGAAGAAGACUGAAGA-CAUACGCACACCUGUUCGACGACAAGGUCAUGAAGCAGCUG<br>AAGAGAAGAAGAUACACAGGAUGGGGAAGACUGAGCAGAAAGCUGAUCAACGGAAUCAGA-GACAAGCAGAGCGGAAAGACAAUCCUGGACUUC | 14 |

-continued

Sequence Table
The following sequence table provides a listing of sequences disclosed herein. It is understood that if a DNA sequence (comprising Ts) is referenced with respect to an RNA, then Ts should be replaced with Us(which may be modified or unmodified depending on the context), and vice versa.

| Description | Sequence | SEQ ID No. |
|---|---|---|
| | CUGAAGAGCGACGGAUUCGCAAACAGAAACUUCAUGCAGCUGAUCCACGACGACAGC-<br>CUGACAUUCAAGGAAGACAUCCAGAAGGCACAGGUC<br>AGCGGACAGGGAGACAGCCUGCACGAACACAUCGCAAACCUGGCAGGAAGCCCGGCAAU-<br>CAAGAAGGGAAUCCUGCAGACAGUCAAGGUCGUC<br>GACGAACUGGUCAAGGUCAUGGGAAGACACAAGCCGGAAAACAUCGU-<br>CAUCGAAAUGGCAAGAGAAAACCAGACAACACAGAAGGGACAGAAG<br>AACAGCAGAGAAAGAAUGAAGAGAAUCGAAGAAGGAAUCAAGGAACUGGGAAGCCAGAUC-<br>CUGAAGGAACACCCGGUCGAAAACACACAGCUG<br>CAGAACGAAAAGCUGUACCUGUACUACCUGCAGAACGGAAGAGACAUGUACGUCGACCAG-<br>GAACUGGACAUCAACAGACUGAGCGACUACGAC<br>GUCGACCACAUCGUCCCGCAGAGCUUCCUGAAGGACGACAGCAUCGACAACAAGGUC-<br>CUGACAAGAAGCGACAAGAACAGAGGAAAGAGCGAC<br>AACGUCCCGAGCGAAGAAGUCGUCAAGAAGAUGAAGAACUACUGGA-<br>GACAGCUGCUGAACGCAAAGCUGAUCACACAGAGAAAGUUCGACAAC<br>CUGACAAAGGCAGAGAGGAGGACUGAGCGAACUGGCAAGGCAGGAUUCAUCAAGA-<br>GACAGCUGGUCGAAACAAGACAGAUCACAAAGCAC<br>GUCGCACAGAUCCUGGACAGCAGAAUGAACACAA-<br>AGUACGACGAAAACGACAAGCUGAUCAGAGAAGUCAAGGUCAUCACACUGAAGAGCAAG<br>CUGGUCAGCGACUUCAGAAAGGACUUCCAGUUCUACAAGGUCAGAGAAAUCAACAACUAC-<br>CACCACGCACACGACGCAUACCUGAACGCAGUC<br>GUCGGAACAGCACUGAUCAAGAAGUACCCGAAGCUGGAAAGCGAAUUCGUCUACGGAGAC-<br>UACAAGGUCUACGACGUCAGAAAGAUGAUCGCA<br>AAGAGCGAACAGGAAAUCGGAAAGGCAACAGCAAAGUACUUCUUCUACAGCAACAU-<br>CAUGAACUUCUUCAAGACAGAAAUCACACUGGCAAAC<br>GGAGAAAUCAGAAAGAGACCGCUGAUCGAAACAAACGGAGAAACAGGAGAAAUCGU-<br>CUGGGACAAGGGAAGAGACUUCGCAACAGUCAGAAAG<br>GUCCUGAGCAUGCCGCAGGUCAACAUCGUCAAGAAGACAGAAGUCCAGACAGGAG-<br>GAUUCAGCAAGGAAAGCAUCCUGCCGAAGAGAAACAGC<br>GACAAGCUGAUCGCAAGAAAGAAGGACUGGGACCCGAAGAAGUACGAG-<br>GAUUCGACAGCCCGACAGUCGCAUACAGCGUCCUGGUCGUCGCA<br>AAGGUCGAAAAGGGAAAGAGCAAGAAGCUGAAGAGCGUCAAGGAACUGCUGGGAAU-<br>CACAAUCAUGGAAAGAAGCAGCUUCGAAAAGAACCCG<br>AUCGACUUCCUGGAAGCAAAGGGAUACAAGGAAGUCAAGAAGGACCUGAUCAU-<br>CAAGCUGCCGAAGUACAGCCUGUUCGAACUGGAAAACGGA<br>AGAAAGAGAAUGCUGGCAAGCGCAGGAGAACUGCAGAAGGGAAACGAACUGGCA-<br>CUGCCGAGCAAGUACGUCAACUUCCUGUACCUGGCAAGC<br>CACUACGAAAAGCUGAAGGGAAGCCCGGAAGACAACGAACAGAAGCAGCUGUUCGU-<br>CGAACAGCACAAGCACUACCUGGACGAAAUCAUCGAA<br>CAGAUCAGCGAAUUCAGCAAGAGAGUCAUCCUGGCAGACGCAAACCUGGACAAGGUC-<br>CUGAGCGCAUACAACAAGCACAGAGACAAGCCGAUC<br>AGAGAACAGGCAGAAAACAUCAUCCACCUGUUCACACUGACAAACCUGG-<br>GAGCACCGGCAGCAUUCAAGUACUUCGACACAACAAUCGACAGA<br>AAGAGAUACACAAGCACAAAGGAAGUCCUGGACGCAACACUGAUCCACCAGAGCAU-<br>CACAGGACUGUACGAAACAAGAAUCGACCUGAGCCAG<br>CUGGGAGGAGACUAG | |
| Cas9 coding sequence encoding SEQ ID NO: 13 using minimal uridine codons as listed in Table 3 (no start or | GACAAGAAGUACAGCAUCGGACUGGACAUCGGAACAAACAGCGUCGGAUGGGCAGUCAU-<br>CACAGACGAAUACAAGGUCCCGAGCCAGAAGUUC<br>AAGGUCCUGGGAAACACAGACAGACACAGCAUCAAGAAGAACCUGAUCGGAGCACUGCU-<br>GUUCGACAGCGGAGAAACAGCAGAAGCAACAAGA<br>CUGAAGAGAACAGCCAAGAAGAGAUACACAAGAAGAAAGAACAGAAUCUGCUACCUGCAG-<br>GAAAUCUUCAGCAACGAAAUGGCAAAGGUCGAC<br>GACAGCUUCUUCCACAGACUGGAAGAAAGCUUCCUGGUCGAAGAA-<br>GACAAGAAGCACAAAGACACCCGAUCUUCGGAAACAUCGUCGACGAA<br>GUCGCAUACCACGAAAAGUACCCGGACAAUCUACCACCUGAGAAAGAAGCUGGU-<br>CGACAGCACAGACAAGGCAGACCUGAGACUGAUCUACCUG<br>GCACUGGCACACAUGAUCAAGUUCAGAGGACACUUCCUGAUCGAAGGAGAC-<br>CUGAACCCGGACAACAGCGACGUCGACAAGCUGUUCAUCCAG<br>CUGGUCCAGACAUACAACCAGCUGUUCGAAGAAAACCCGAUCAACGCAAGCGGAGU-<br>CGACGCAAAGGCAAUCCUGAGCGCAAGACUGAGCAAG<br>AGCAGAAGACUGGAAAACCUGAUCGCACAGCUGCCGGGAGAAAAGAAGAACGGACU-<br>GUUCGGAAACCUGAUCGCACUGAGCCUGGGACUGACA<br>CCGAACUUCAAGAGCAACUUCGACCUGGCAGAA-<br>GACGCAAAGCUGCAGCUGAGCAAGGACACAUACGACGACGACCUGGACAACCUGCUGGCA<br>CAGAUCGGAGACCAGUACGCAGACCUGUUCCUGGCAGCAAAGAACCUGAGCGACGCAAUC-<br>CUGCUGAGCGACAUCCUGAGAGUCAACACAGAA<br>AUCACAAAGGCACCGCUGAGCGCAAGCAUGAUCAAGAGAUACGACGAACACCACCAGGAC-<br>CUGACACUGCUGAAGGCACUGGUCAGACAGCUG<br>CUGCCGGAAAAGUACAAGGAAAUCUUCUUCGACCAGAGCAAGAACGGAUACGCAGGAUA-<br>CAUCGACGGAGGAGCAAGCCAGGAAGAAUUCUAC<br>AAGUUCAUCAAGCCGAUCCUGGAAAAGAUGGACGGAACAGAAGAACCUGCUGGU-<br>CAAGCUGAACAGAGAAGACCUGCUGAGAAAGCAGAGAACA<br>UUCGACAACGGAAGCAUCCCGCACCAGAUCCACCUGGGAGAACUGCACGCAAUC-<br>CUGAGAGACAGGAAGACUUCUACCCGUUCCUGAAGGAC<br>AACAGAGAAAAGAUCGAAAAGAUCCUGACAUUCAGAAUCCCGUACUACGU-<br>CGGACCGCUGGCAAGAGGAAACAGCAGAUUCGCAUGGAUGACA | 15 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| stop codons; suitable for inclusion in fusion protein coding sequence) | AGAAAGAGCGAAGAAACAAUCACACCGUGGAACUUCGAAGAAGUCGUCGACAAGG-GAGCAAGCGCACAGAGCUUCAUCGAAAGAAUGACAAAC UUCGACAAGAACCUGCCGAACGAAAAGGUCCUGCCGAAGCACAGCCUGCUGUACGAAUAC-UUCACAGUCUACAACGAACUGACAAAGGUCAAG UACGUCACAGAAGGAAUGAGAAAGCCGGCAUUCCUGAGCGGAGAACAGAAGAAGGCAAUC-GUCGACCUGCUGUUCAAGACAAACAGAAAGGUC ACAGUCAAGCAGCUGAAGGAAGACUACUUCAAGAAGAUCGAAUGCUUCGACAGCGU-CGAAAUCAGCGGAGUCGAAGACAGAUUCAACGCAAGC CUGGGAACAUACCACGACCUGCUGAAGAUCAUCAAGGACAAGGACUUC-CUGGACAACGAAGAAAACGAAGACAUCCUGGAAGACAUCGUCCUG ACACUGACACUGUUCGAAGACAGAGAAAUGAUCGAAGAAAGACUGAAGCAUACGCACAC-CUGUUCGACGACAAGGUCAUGAAGCAGCUGAAG AGAAGAAGAUACACAGGAUGGGGAAGACUGAGCAGAAAGCUGAUCAACGGAAUCAGA-GACAAGCAGAGCGGAAAGACAAUCCUGGACUUCCUG AAGAGCGACGGAUUCGCAAACAGAAACUUCAUGCAGCUGAUCCACGACGACAGCCUGA-CAUUCAAGGAAGACAUCCAGAAGGCACAGGUCAGC GGACAGGGAGACAGCCUGCACGAACACAUCGCAAACCUGGCAGGAAGCCCGGCAAU-CAAGAAGGGAAUCCUGCAGACAGUCAAGGUCGUCGAC GAACUGGUCAAGGUCAUGGGAAGACACAAGCCGGAAAACAUCGU-CAUCGAAAUGGCAAGAGAAAACCAGACAACAACAGAAGGGACAGAAGAAC AGCAGAGAAAGAAUGAAGGAAUCGAAGAAGGAAUCAAGGAACUGGGAAGCCAGAUC-CUGAAGGAACACCCGGUCGAAAACACACAGCUGCAG AACGAAAAGCUGUACCUGUACUACCUGCAGAACGGAAGAGAGCAUGUACGUCGACCAG-GAACUGGACAUCAACAGACUGAGCGACUACGACGUC GACCACAUCGUCCCGCAGAGCUUCCUGAAGGACGACAGCAUCGACAACAAGGUC-CUGACAAGAAGCGACAAGAACAGAGGAAAGAGCGACAAC GUCCCGAGCGAAGAAGUCGUCAAGAAGAUGAAGAACUACUGGA-GACAGCUGCUGAACGCAAAGCUGAUCACACAGAGAAAGUUCGACAACCUG ACAAAGGCAGAGAGAGGAGGACUGAGCGAACUGGACAAGGCAGGAUUCAUCAAGA-GACAGCUGGUCGAAACAAGACAGAUCACAAAGCACGUC GCACAGAUCCUGGACAGCAGAAUGAACACAA-AGUACGACGAAAACGACAAGCUGAUCAGAGAAGUCAAGGUCAUCACACUGAAGAGCAAGCUG GUCAGCGACUUCAGAAAGGACUUCCAGUUCUACAAGGUCAGAGAAAUCAACAACUACCAC-CACGCACACGACGCAUACCUGAACGCAGUCGUC GGAACAGCACUGAUCAAGAAGUACCCGAAGCUGGAAAGCGAAUUCGUCUACGGAGACUA-CAAGGUCUACGACGUCAGAAAGAUGAUCGCAAAG AGCGAACAGGAAAUCGGAAAGGCAACAGCAAAGUACUUCUUCUACAGCAACAUCAUGAAC-UUCUUCAAGACAGAAAUCACACUGGCAAACGGA GAAAUCAGAAAGAGACCGCUGAUCGAAACAAACGGAGAAACAGGAGAAAUCGU-CUGGGACAAGGGAAGAGACUUCGCAACAGUCAGAAAGGUC CUGAGCAUGCCGCAGGUCAACAUCGUCAAGAAGACAGAAGUCCAGACAGGAG-GAUUCAGCAAGGAAAGCAUCCUGCCGAAGAGAAACAGCGAC AAGCUGAUCGCAAGAAAGAAGGACUGGGACCCGAAGAAGUACGGAG-GAUUCGACAGCCCGACAGUCGCAUACAGCGUCCUGGUCGUCGCAAAG GUCGAAAAGGGAAAGAGCAAGAAGCUGAAGAGCGUCAAGGAACUGCUGGGAAUCACAAU-CAUGGAAAGAAGCAGCUUCGAAAAGAACCCGAUC GACUUCCUGGAAGCAAAGGGAUACAAGGAAGUCAAGAAGGACCUGAUCAU-CAAGCUGCCGAAGUACAGCCUGUUCGAACUGGAAAACGGAAGA AAGAGAAUGCUGGCAAGCGCAGGAGAACUGCAGAAGGGAAACGAACUGGCA-CUGCCGAGCAAGUACGUCAACUUCCUGUACCUGGCAAGCCAC UACGAAAAGCUGAAGGGAAGCCCGAAGACAACGAACAGAAGCAGCUGUUCGU-CGAACAGCACAAGCACUACCUGGACGAAAUCAUCGAACAG AUCAGCGAAUUCAGCAAGAGAGUCAUCCUGGCAGACGCAAACCUGGACAAGGUC-CUGAGCGCAUACAACAAGCACAGAGACAAGCCGAUCAGA GAACAGGCAGAAAACAUCAUCCACCUGUUCACACUGACAAACCUGGGAGCACCGGCAG-CAUUCAAGUACUUCGACACAACAAUCGACAGAAAG AGAUACACAAGCACAAAGGAAGUCCUGGACGCAACACUGAUCCACCAGAGCAU-CACAGGACUGUACGAAACAAGAAUCGACCUGAGCCAGCUG GGAGGAGAC | |
| Amino acid sequence of Cas9 nickase (with- | MDKKYSIGLAIGTNSVGWAVITDEYKVPSKKFKVLGNTDRHSIKKNLIGALLFDSGETAE-ATRLKRTARRRYTRRKNRICYLQEIFSNEMAKV DDSFFHRLEESFLVEEDKKHERHPIFGNIVDEVAYHEKYPTIYHLRKKLVD-STDKADLRLIYLALAHMIKFRGHFLIEGDLNPDNSDVDKLFI QLVQTYNQLFEENPINASGVDAKAILSARLSKSRRLENLIAQLPGEKKNGLFGNLIA-LSLGLTPNFKSNFDLAEDAKLQLSKDTYDDDLDNLL AQIGDQYADLFLAAKNLSDAILLSDILRVNTEITKAPLSASMIKRYDEHHQDLTLLKA-LVRQQLPEKYKEIFFDQSKNGYAGYIDGGASQEEF YKFIKPILEKMDGTEELLVKLNREDLLRKQRTFDNGSIPHQIHLGELHAILRRQEDFYP-FLKDNREKIEKILTFRIPYYVGPLARGNSRFAWM TRKSEETITPWNFEEVVDKGASAQSFIERMTNFDKNLPNEKVLPKHSLLY-EYFTVYNELTKVKYVTEGMRKPAFLSGEQKKAIVDLLFKTNRK VTVKQLKEDYFKKIECFDSVEISGVEDRFNASLGTYHDLLKIIKDKDFLDNEENEDILE-DIVLTLTLFEDREMIEERLKTYAHLFDDKVMKQL | 16 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| out NLS) | KRRRYTGWGRLSRKLINGIRDKQSGKTILDFLKSDGFANRNFMQLIHDD-SLTFKEDIQKAQVSGQGDSLHEHIANLAGSPAIKKGILQTVKVV DELVKVMGRHKPENIVIEMARENQTTQKGQKNSRERMKRIEEGIKEL-GSQILKEHPVENTQLQNEKLYLYYLQNGRDMYVDQELDINRLSDYD VDHIVPQSFLKDDSIDNKVLTRSDKNRGKSDNVPSEEVVKKMKNYWRQLLNAK-LITQRKFDNLIKAERGGLSELDKAGFIKRQLVETRQITKH VAQILDSRMNTKYDENDKLIREVKVITLKSKLVSDFRKDFQFYKVREINNYHHAHDAYL-NAVVGTALIKKYPKLESEFVYGDYKVYDVRKMIA KSEQEIGKATAKYFFYSNIMNFFKTEITLANGEIRKRPLIETNGETGEIVWDKGRDFA-TVRKVLSMPQVNIVKKTEVQTGGFSKESILPKRNS DKLIARKKDWDPKKYGGFDSPTVAYSVLVVAKVEKGKSKKLKSVKELLGITIMERSS-FEKNPIDFLEAKGYKEVKKDLIIKLPKYSLFELENG RKRMLASAGELQKGNELALPSKYVNFLYLASHYEKLKGSPEDNEQKQLFVEQHKHYL-DEIIEQISEFSKRVILADANLDKVLSAYNKHRDKPI REQAENIIHLFTLTNLGAPAAFKYFDTTIDRKRYTSTKEVLDATLIHQSITGLYETRIDLSQLGGD | |
| Cas9 nickase mRNA ORF encoding SEQ ID NO: 16 using minimal uridine codons as listed in Table 3, with start and stop codons | AUGGACAAGAAGUACAGCAUCGGACUGGCAAUCGGAACAAACAGCGUCGGAUGGGCAGU-CAUCACAGACGAAUACAAGGUCCCGAGCAAGAAG UUCAAGGUCCUGGGAAACACAGACAGACACAGCAUCAAGAAGAACCUGAUCGGAGCA-CUGCUGUUCGACAGCGGAGAAACAGCAGAAGCAACA AGACUGAAGAGACAAGCAGGAAGAAGAUACAAGAAGAAAGAACAGAAUCUGCUAC-CUGCAGGAAAUCUUCAGCAACGAAAUGGCAAAGGUC GACGACAGCUUCUUCCACAGACUGGAAGAAAGCUUCCUGGUCGAAGAA-GACAAGAAGCACGAAAGACACCCGAUCUUCGGAAACAUCGUCGAC GAAGUCGCAUACCACGAAAAGUACCCGACAAUCUACCACCUGAGAAAGAAGCUGGU-CGACAGCACAGACAAGGCAGACCUGAGACUGAUCUAC CUGGCACUGGCACACAUGAUCAAGUUCAGAGGACACUUCCUGAUCGAAGGAGAC-CUGAACCCGGACAACAGCGACGUCGACAAGCUGUUCAUC CAGCUGGUCCAGACAUACAACCAGCUGUUCGAAGAAAACCCGAUCAACGCAAGCGGAGU-CGACGCAAAGGCAAUCCUGAGCGCAAGACUGAGC AAGAGCAGAAGACUGGAAAACCUGAUCGCACAGCUGCCGGGAGAAAAGAAGAACGGACU-GUUCGGAAACCUGAUCGCACUGAGCCUGGGACUG ACACCGAACUUCAAGAGCAACUUCGACCUGGCAGAA-GACAAAGCUGCAGCUGAGCAAGGACACAUACGACGACCUGGACAACCUGCUG GCACAGAUCGGAGACCAGUACGCAGACCUGUUCCUGGCAGCAAAGAAC-CUGAGCGACGCAAUCCUGCUGAGCGACAUCCUGAGAGUCAACACA GAAAUCACAAAGGCACCGCUGAGCGCAAGCAUGAUCAAGAGAUACGACGAACAC-CACCAGGACCUGACACUGCUGAAGGCACUGGUCAGACAG CAGCUGCCGGAAAAGUACAAGGAAAUCUUCUUCGACCAGAGCAAGAACGGAUACGCAG-GAUACAUCGACGGAGGAGCAAGCCAGGAAGAAUUC UACAAGUUCAUCAAGCCGAUCCUGGAAAAGAUGGACGGAACAGAAGAACUGCUGGU-CAAGCUGAACAGAGAAGACCUGCUGAAAGCAGAGA ACAUUCGACAACGGAAGCAUCCCGCACCAGAUCCACCUGGGAGAACUGCACGCAAUC-CUGAGAAGACAGGAAGACUUCUACCCGUUCCUGAAG GACAACAGAGAAAAGAUCGAAAAGAUCCUGACAUUCAGAAUCCCGUACUACGU-CGGACCGCUGGCAAGAGGGAAACAGCAGAUUCGCAUGGAUG ACAAGAAAGAGCGAAGAAACAAUCACACCGUGGAACUUCGAAGAAGUCGUCGACAAGG-GAGCAAGCGCACAGAGCUUCAUCGAAAGAAUGACA AACUUCGACAAGAACCUGCCGAACGAAAAGGUCCUGCCGAAGCACAGCCUGCU-GUACGAAUACUUCACAGUCUACAACGAACUGACAAAGGUC AAGUACGUCACAGAAGGAAUGAGAAAGCCGGCAUUCCUGAGCG-GAGAACAGAAGAAGGCAAUCGUCGACCUGCUGUUCAAGACAAACAGAAAG GUCACAGUCAAGCAGCUGAAGGAAGACUACUUCAAGAAGAUCGAAUGCUUCGACAGCGU-CGAAAUCAGCGGAGUCGAAGACAGAUUCAACGCA AGCCUGGGAACAUACCACGACCUGCUGAAGAUCAUCAAGGACAAGGACUUC-CUGGACAACGAAGAAAACGAAGACAUCCUGGAAGACAUCGUC CUGACACUGACACUGUUCGAAGACAGAGAAAUGAUCGAAGAAAGACUGAAGA-CAUACGCACACCUGUUCGACGACAAGGUCAUGAAGCAGCUG AAGAGAAGAAGAUACACAGGAUGGGGAAGACUGAGCAGAAAGCUGAUCAACGGAAUCAGA-GACAAGCAGAGCGGAAAGACAAUCCUGGACUUC CUGAAGAGCGACGGAUUCGCAAACAGAAACUUCAUGCAGCUGAUCCACGACGACAGC-CUGACAUUCAAGGAAGACAUCCAGAAGGCACAGGUC AGCGGACAGGGAGACAGCCUGCACGAACACAUCGCAAACCUGGCAGGAAGCCCGGCAAU-CAAGAAGGGAAUCCUGCAGACAGUCAAGGUCGUC GACGAACUGGUCAAGGUCAUGGGAAGACACAAGCCGGAAAACAUCGU-CAUCGAAAUGGCAAGAGAAAACCAGACAACACAGAAGGGACAGAAG AACAGCAGAGAAGAAUGAAGAGAAUCGAAGAGGAAUCAAGGAACUGGGAAGCCAGAUC-CUGAAGGAACACCCGGUCGAAAACACACAGCUG CAGAACGAAAAGCUGUACCUGUACUACCUGCAGAACGGAAGAGACAUGUACGUCGACCAG-GAACUGGACAUCAACAGACUGAGCGACUACGAC GUCGACCACAUCGUCCCGCAGAGCUUCCUGAAGGACGACAGCAUCGACAACAAGGUC-CUGACAAGAAGCGACAAGAACAGAGGAAAGAGCGAC AACGUCCCGAGCGAAGAAGUCGUCAAGAAGAUGAAGAACUACUGGA-GACAGCUGCUGAACGCAAAGCUGAUCACACAGAGAAAGUUCGACAAC CUGACAAAGGCAGAGAGGAGGACUGAGCGAACUGGACAAGGCAGGAUUCAUCAAGA-GACAGCUGGUCGAAACAAGACAGAUCACAAAGCAC | 17 |

| Description | Sequence | SEQ ID No. |
|---|---|---|
| | GUCGCACAGAUCCUGGACAGCAGAAUGAACACAA-<br>AGUACGACGAAAACGACAAGCUGAUCAGAGAAGUCAAGGUCAUCACACUGAAGAGCAAG<br>CUGGUCAGCGACUUCAGAAAGGACUUCCAGUUCUACAAGGUCAGAGAAAUCAACAACUAC-<br>CACCACGCACACGACGCAUACCUGAACGCAGUC<br>GUCGGAACAGCACUGAUCAAGAAGUACCCGAAGCUGGAAAGCGAAUUCGUCUACGGAGAC-<br>UACAAGGUCUACGACGUCAGAAAGAUGAUCGCA<br>AAGAGCGAACAGGAAAUCGGAAAGGCAACAGCAAAGUACUUCUUCUACAGCAACAU-<br>CAUGAACUUCUUCAAGACAGAAAUCACACUGGCAAAC<br>GGAGAAAUCAGAAAGAGACCGCUGAUCGAAACAAACGGAGAAACAGGAGAAAUCGU-<br>CUGGGACAAGGGAAGAGACUUCGCAACAGUCAGAAAG<br>GUCCUGAGCAUGCCGCAGGUCAACAUCGUCAAGAAGACAGAAGUCCAGACAGGAG-<br>GAUUCAGCAAGGAAAGCAUCCUGCCGAAGAGAAACAGC<br>GACAAGCUGAUCGCAAGAAAGAAGGACUGGGACCCGAAGAAGUACGGAG-<br>GAUUCGACAGCCCGACAGUCGCAUACAGCGUCCUGGUCGUCGCA<br>AAGGUCGAAAAGGGAAAGAGCAAGAAGCUGAAGAGCGUCAAGGAACUGCUGGGAAU-<br>CACAAUCAUGGAAAGAAGCAGCUUCGAAAAGAACCCG<br>AUCGACUUCCUGGAAGCAAAGGGAUACAAGGAAGUCAAGAAGGACCUGAUCAU-<br>CAAGCUGCCGAAGUACAGCCUGUUCGAACUGGAAAACGGA<br>AGAAAGAGAAUGCUGGCAAGCGCAGGAGAACUGCAGAAGGGAAACGAACUGGCA-<br>CUGCCGAGCAAGUACGUCAACUUCCUGUACCUGGCAAGC<br>CACUACGAAAAGCUGAAGGGAAGCCCGGAAGACAACGAACAGAAGCAGCUGUUCGU-<br>CGAACAGCACAAGCACUACCUGGACGAAAUCAUCGAA<br>CAGAUCAGCGAAUUCAGCAAGAGAGUCAUCCUGGCAGACGCAAACCUGGACAAGGUC-<br>CUGAGCGCAUACAACAAGCACAGAGACAAGCCGAUC<br>AGAGAACAGGCAGAAAACAUCAUCCACCUGUUCACACUGACAAACCUGG-<br>GAGCACCGGCAGCAUUCAAGUACUUCGACACAACAAUCGACAGA<br>AAGAGAUACACAAGCACAAAGGAAGUCCUGGACGCAACACUGAUCCACCAGAGCAU-<br>CACAGGACUGUACGAAACAAGAAUCGACCUGAGCCAG<br>CUGGGAGGAGACUAG | |
| Cas9 nickase coding sequence encoding SEQ ID NO: 16 using minimal uridine codons as listed in Table 3 (no start or stop codons; suitable for inclusion in fusion | GACAAGAAGUACAGCAUCGGACUGGCAAUCGGAACAAACAGCGUCGGAUGGGCAGUCAU-<br>CACAGACGAAUACAAGGUCCCGAGCAAGAAGUUC<br>AAGGUCCUGGGAAACACAGACAGACACAGCAUCAAGAAGAACCUGAUCGGAGCACUGCU-<br>GUUCGACAGCGGAGAAACAGCAGAAGCAACAAGA<br>CUGAAGAGAACAGCAAGAAGAAGAUACACAAGAAGAAAGAACAGAAUCUGCUACCUGCAG-<br>GAAAUCUUCAGCAACGAAAUGGCAAAGGUCGAC<br>GACAGCUUCUUCCACAGACUGGAAGAAAGCUUCCUGGUCGAAGAA-<br>GACAAGAAGCACGAAAGACACCCGAUCUUCGGAAACAUCGUCGACGAA<br>GUCGCAUACCACGAAAAGUACCCGACAAUCUACCACCUGAGAAAGAAGCUGGU-<br>CGACAGCACAGACAAGGCAGACCUGAGACUGAUCUACCUG<br>GCACUGGCACACAUGAUCAAGUUCAGAGGACACUUCCUGAUCGAAGGAGAC-<br>CUGAACCCGGACAACAGCGACGUCGACAAGCUGUUCAUCCAG<br>CUGGUCCAGACAUACAACCAGCUGUUCGAAGAAAACCCGAUCAACGCAAGCGGAGU-<br>CGACGCAAAGGCAAUCCUGAGCGCAAGACUGAGCAAG<br>AGCAGAAGACUGGAAAACCUGAUCGCACAGCUGCCGGGAGAAAAGAAGAACGGACU-<br>GUUCGGAAACCUGAUCGCACUGAGCCUGGGACUGACA<br>CCGAACUUCAAGAGCAACUUCGACCUGGCAGAA-<br>GACGCAAAGCUGCAGCUGAGCAAGGACACAUACGACGACGACCUGGACAACCUGCUGGCA<br>CAGAUCGGAGACCAGUACGCAGACCUGUUCCUGGCAGCAAAGAACCUGAGCGACGCAAUC-<br>CUGCUGAGCGACAUCCUGAGAGUCAACACAGAA<br>AUCACAAAGGCACCGCUGAGCGCAAGCAUGAUCAAGAGAUACGACGAACACCACCAGGAC-<br>CUGACACUGCUGAAGGCACUGGUCAGACAGCAG<br>CUGCCGGAAAAGUACAAGGAAAUCUUCUUCGACCAGAGCAAGAACGGAUACGCAGGAUA-<br>CAUCGACGGAGGAGCAAGCCAGGAAGAAUUCUAC<br>AAGUUCAUCAAGCCGAUCCUGGAAAAGAUGGACGGAACAGAAGAACUGCUGGU-<br>CAAGCUGAACAGAGAAGACCUGCUGAGAAAGCAGAGAACA<br>UUCGACAACGGAAGCAUCCCGCACCAGAUCCACCUGGGAGAACUGCACGCAAUC-<br>CUGAGAAGACAGGAAGACUUCUACCCGUUCCUGAAGGAC<br>AACAGAGAAAAGAUCGAAAAGAUCCUGACAUUCAGAAUCCCGUACUACGU-<br>CGGACCGCUGGCAAGAGGAAACAGCAGAUUCGCAUGGAUGACA<br>AGAAAGAGCGAAGAAACAAUCACACCGUGGAACUUCGAAGAAGUCGUCGACAAGG-<br>GAGCAAGCGCACAGAGCUUCAUCGAAAGAAUGACAAAC<br>UUCGACAAGAACCUGCCGAACGAAAAGGUCCUGCCGAAGCACAGCCUGCUGUACGAAUAC-<br>UUCACAGUCUACAACGAACUGACAAAGGUCAAG<br>UACGUCACAGAAGGAAUGAGAAAGCCGGCAUUCCUGAGCGGAGAACAGAAGAAGGCAAUC-<br>GUCGACCUGCUGUUCAAGACAAACAGAAAGGUC<br>ACAGUCAAGCAGCUGAAGGAAGACUACUUCAAGAAGAUCGAAUGCUUCGACAGCGU-<br>CGAAAUCAGCGGAGUCGAAGACAGAUUCAACGCAAGC<br>CUGGGAACAUACCACGACCUGCUGAAGAUCAUCAAGGACAAGGACUUC-<br>CUGGACAACGAAGAAAACGAAGACAUCCUGGAAGACAUCGUCCUG<br>ACACUGACACUGUUCGAAGACAGAGAAAUGAUCGAAGAAAGACUGAAGACAUACGCACAC-<br>CUGUUCGACGACAAGGUCAUGAAGCAGCUGAAG | 18 |

| Description | Sequence | SEQ ID No. |
|---|---|---|
| protein coding sequence) | AGAAGAAGAUACACAGGAUGGGGAAGACUGAGCAGAAAGCUGAUCAACGGAAUCAGA-GACAAGCAGAGCGGAAAGACAAUCCUGGACUUCCUG<br>AAGAGCGACGGAUUCGCAAACAGAAACUUCAUGCAGCUGAUCCACGACGACAGCCUGA-CAUUCAAGGAAGACAUCCAGAAGGCACAGGUCAGC<br>GGACAGGGAGACAGCCUGCACGAACACAUCGCAAACCUGGCAGGAAGCCCGGCAAU-CAAGAAGGGAAUCCUGCAGACAGUCAAGGUCGUCGAC<br>GAACUGGUCAAGGUCAUGGGAAGACACAAGCCGGAAAACAUCGU-CAUCGAAAUGGCAAGAGAAAACCAGACAACACAGAAGGGACAGAAGAAC<br>AGCAGAGAAAGAAUGAAGAGAAUCGAAGAAGGAAUCAAGGAACUGGGAAGCCAGAUC-CUGAAGGAACACCCGGUCGAAAACACACAGCUGCAG<br>AACGAAAAGCUGUACCUGUACUACCUGCAGAACGGAAGAGACAUGUACGUCGACCAG-GAACUGGACAUCAACAGACUGAGCGACUACGACGUC<br>GACCACAUCGUCCCGCAGAGCUUCCUGAAGGACGACAGCAUCGACAACAAGGUC-CUGACAAGAAGCGACAAGAACAGAGGAAAGAGCGACAAC<br>GUCCCGAGCGAAGAAGUCGUCAAGAAGAUGAAGAACUACUGGA-GACAGCUGCUGAACGCAAAGCUGAUCACACAGAGAAAGUUCGACAACCUG<br>ACAAAGGCAGAGAGGAGGACUGAGCGAACUGGACAAGGCAGGAUUCAUCAAGA-GACAGCUGGUCGAAACAAGACAGAUCACAAAGCACGUC<br>GCACAGAUCCUGGACAGCAGAAUGAACACAA-AGUACGACGAAAACGACAAGCUGAUCAGAGAAGUCAAGGUCAUCACACUGAAGAGCAAGCUG<br>GUCAGCGACUUCAGAAAGGACUUCCAGUUCUACAAGGUCAGAGAAAUCAACAACUACCAC-CACGCACACGACGCAUACCUGAACGCAGUCGUC<br>GGAACAGCACUGAUCAAGAAGUACCCGAAGCUGGAAAGCGAAUUCGUCUACGGAGACUA-CAAGGUCUACGACGUCAGAAAGAUGAUCGCAAAG<br>AGCGAACAGGAAAUCGAAAGGCAACAGCAAAGUACUUCUUCUACAGCAACAUCAUGAAC-UUCUUCAAGACAGAAAUCACACUGGCAAACGGA<br>GAAAUCAGAAAGAGACCGCUGAUCGAAACAAACGGAGAAACAGGAGAAAUCGU-CUGGGACAAGGGAAGAGACUUCGCAACAGUCAGAAAGGUC<br>CUGAGCAUGCCGCAGGUCAACAUCGUCAAGAAGACAGAAGUCCAGACAGGAG-GAUUCAGCAAGGAAAGCAUCCUGCCGAAGAGAAACAGCGAC<br>AAGCUGAUCGCAAGAAAGAAGGACUGGGACCCGAAGAAGUACGGAG-GAUUCGACAGCCCGACAGUCGCAUACAGCGUCCUGGUCGUCGCAAAG<br>GUCGAAAAGGGAAAGAGCAAGAAGCUGAAGAGCGUCAAGGAACUGCUGGGAAUCACAAU-CAUGGAAAGAAGCAGCUUCGAAAAGAACCCGAUC<br>GACUUCCUGGAAGCAAAGGGAUACAAGGAAGUCAAGAAGGACCUGAUCAU-CAAGCUGCCGAAGUACAGCCUGUUCGAACUGGAAAACGGAAGA<br>AAGAGAAUGCUGGCAAGCGCAGGAGAACUGCAGAAGGGAAACGAACUGGCA-CUGCCGAGCAAGUACGUCAACUUCCUGUACCUGGCAAGCCAC<br>UACGAAAAGCUGAAGGGAAGCCCGGAAGACAACGAACAGAAGCAGCUGUUCGU-CGAACAGCACAAGCACUACCUGGACGAAAUCAUCGAACAG<br>AUCAGCGAAUUCAGCAAGAGAGUCAUCCUGGCAGACGCAAACCUGGACAAGGUC-CUGAGCGCAUACAACAAGCACAGAGACAAGCCGAUCAGA<br>GAACAGGCAGAAAACAUCAUCCACCUGUUCACACUGACAAACCUGGGAGCACCGGCAG-CAUUCAAGUACUUCGACACAACAAUCGACAGAAAG<br>AGAUACACAAGCACAAAGGAAGUCCUGGACGCAACACUGAUCCACCAGAGCAU-CACAGGACUGUACGAAACAAGAAUCGACCUGAGCCAGCUG<br>GGAGGAGAC | |
| Amino acid sequence of dCas9 (without NLS) | MDKKYSIGLAIGTNSVGWAVITDEYKVPSKKFKVLGNTDRHSIKKNLIGALLFDSGETAE-ATRLKRTARRRYTRRKNRICYLQEIFSNEMAKV<br>DDSFFHRLEESFLVEEDKKHERHPIFGNIVDEVAYHEKYPTIYHLRKKLVD-STDKADLRLIYLALAHMIKFRGHFLIEGDLNPDNSDVDKLFI<br>QLVQTYNQLFEENPINASGVDAKAILSARLSKSRRLENLIAQLPGEKKNGLFGNLIA-LSLGLIPNFKSNFDLAEDAKLQLSKDTYDDDLDNLL<br>AQIGDQYADLFLAAKNLSDAILLSDILRVNTEITKAPLSASMIKRYDEHHQDLILLKA-LVRQQLPEKYKEIFFDQSKNGYAGYIDGGASQEEF<br>YKFIKPILEKMDGTEELLVKLNREDLLRKQRTFDNGSIPHQIHLGELHAILRRQEDFYP-FLKDNREKIEKILTFRIPYYVGPLARGNSRFAWM<br>TRKSEETITPWNFEEVVDKGASAQSFIERMTNFDKNLPNEKVLPKHSLLY-EYFTVYNELTKVKYVTEGMRKPAFLSGEQKKAIVDLLFKTNRK<br>VTVKQLKEDYFKKIECFDSVEISGVEDRFNASLGTYHDLLKIIKDKDFLDNEENEDILE-DIVLTLTLFEDREMIEERLKTYAHLFDDKVMKQL<br>KRRRYTGWGRLSRKLINGIRDKQSGKTILDFLKSDGFANRNFMQLIHDD-SLTFKEDIQKAQVSGQGDSLHEHIANLAGSPAIKKGILQTVKVV<br>DELVKVMGRHKPENIVIEMARENQTTQKGQKNSRERMKRIEEGIKEL-GSQILKEHPVENTQLQNEKLYLYYLQNGRDMYVDQELDINRLSDYD<br>VDAIVPQSFLKDDSIDNKVLTRSDKNRGKSDNVPSEEVVKKMKNYWRQLLNAK-LITQRKFDNLTKAERGGLSELDKAGFIKRQLVETRQITKH<br>VAQILDSRMNTKYDENDKLIREVKVITLKSKLVSDFRKDFQFYKVREINNYHHAHDAYL-NAVVGTALIKKYPKLESEFVYGDYKVYDVRKMIA<br>KSEQEIGKATAKYFFYSNIMNFFKTEITLANGEIRKRPLIETNGETGEIVWDKGRDFA-TVRKVLSMPQVNIVKKTEVQTGGFSKESILPKRNS | 19 |

| Description | Sequence | SEQ ID No. |
|---|---|---|
| | DKLIARKKDWDPKKYGGFDSPTVAYSVLVVAKVEKGKSKKLKSVKELLGITIMERSS-<br>FEKNPIDFLEAKGYKEVKKDLIIKLPKYSLFELENG<br>RKRMLASAGELQKGNELALPSKYVNFLYLASHYEKLKGSPEDNEQKQLFVEQHKHYL-<br>DEIIEQISEFSKRVILADANLDKVLSAYNKHRDKPI<br>REQAENIIHLFTLINLGAPAAFKYFDTTIDRKRYTSTKEVLDATLIHQSITGLYETRIDLSQLGGD | |
| dCas9 mRNA ORF encoding SEQ ID NO: 19 using minimal uridine codons as listed in Table 3, with start and stop codons | AUGGACAAGAAGUACAGCAUCGGACUGGCAAUCGGAACAAACAGCGUCGGAUGGGCAGU-<br>CAUCACAGACGAAUACAAGGUCCCGAGCAAGAAG<br>UUCAAGGUCCUGGGAAACACAGACAGACAGCAUCAAGAAGAACCUGAUCGGAGCA-<br>CUGCUGUUCGACAGCGGAGAAACAGCAGAAGCAACA<br>AGACUGAAGAGACAAGCAAGAAGAAGAUACAAGAAGAAAGAACAGAAUCUGCUAC-<br>CUGCAGGAAAUCUUCAGCAACGAAAUGGCAAAGGUC<br>GACGACAGCUUCUUCCACAGACUGGAAGAAAGCUUCCUGGUCGAAGAA-<br>GACAAGAAGCACGAAAGACACCCGAUCUUCGGAAACAUCGUCGAC<br>GAAGUCGCAUACCACGAAAAGUACCCGACAAUCUACCACCUGAGAAAGAAGCUGGU-<br>CGACAGCACAGACAAGGCAGACCUGAGACUGAUCUAC<br>CUGGCACUGGCACACAUGAUCAAGUUCAGAGGACACUUCCUGAUCGAAGGAGAC-<br>CUGAACCCGGACAACAGCGACGUCGACAAGCUGUUCAUC<br>CAGCUGGUCCAGACAUACAACCAGCUGUUCGAAGAAAACCCGAUCAACGCAAGCGGAGU-<br>CGACGCAAAGGCAAUCCUGAGCGCAAGACUGAGC<br>AAGAGCAGAAGACUGGAAAACCUGAUCGCACAGCUGCCGGGAGAAAAGAAGAACGGACU-<br>GUUCGGAAACCUGAUCGCACUGAGCCUGGGACUG<br>ACACCGAACUUCAAGAGCAACUUCGACCUGGCAGAA-<br>GACGAAAGCUGCAGCUGAGCAAGGACACAUACGACGACGACCUGGACAACCUGCUG<br>GCACAGAUCGGAGACCAGUACGCAGACCUGUUCCUGGCAGCAAAGAAC-<br>CUGAGCGACGCAAUCCUGCUGAGCGACAUCCUGAGAGUCAACACA<br>GAAAUCACAAAGGCACCGCUGAGCGCAAGCAUGAUCAAGAGAUACGACGAACAC-<br>CACCAGGACCUGACCUGAAGGCACUGGUCAGACAG<br>CAGCUGCCGGAAAAGUACAAGGAAAUCUUCUUCGACCAGAGCAAGAACGGAUACGCAG-<br>GAUACAUCGACGGAGGAGCAAGCCAGGAAGAAUUC<br>UACAAGUUCAUCAAGCCGAUCCUGGAAAAGAUGGACGGAACAGAAGAACUGCUGGU-<br>CAAGCUGAACAGAGAAGACCUGCUGAAAGCAGAGA<br>ACAUUCGACAACGGAAGCAUCCCGCACCAGAUCCACCUGGGAGAACUGCACGCAAUC-<br>CUGAGAAGACAGGAAGACUUCUACCCGUUCCUGAAG<br>GACAACAGAGAAAAGAUCGAAAAGAUCCUGACAUUCAGAAUCCCGUACUACGU-<br>CGGACCGCUGGCAAGAGGAAACAGCAGAUUCGCAUGGAUG<br>ACAAGAAAGAGCGAAGAAACAAUCACACCGUGGAACUUCGAAGAAGUCGUCGACAAGG-<br>GAGCAAGCGCACAGAGCUUCAUCGAAAGAAUGACA<br>AACUUCGACAAGAACCUGCCGAACGAAAAGGUCCUGCCGAAGCACAGCCUGCU-<br>GUACGAAUACUUCACAGUCUACAACGAACUGACAAAGGUC<br>AAGUACGUCACAGAAGGAAUGCUCAAAGCCGGCAUUCCUGAGCG-<br>GAGAACAGAAGAAGGCAAUCGUCGACCUGCUGUUCAAGACAAACAGAAAG<br>GUCACAGUCAAGCAGCUGAAGGAAGACUACUUCAAGAAGAUCGAAUGCUUCGACAGCGU-<br>CGAAAAUCAGCGGAGUCGAAGACAGAUUCAACGCA<br>AGCCUGGGAACAUACCACGACCUGCUGAAGAUCAUCAAGGACAAGGACUUC-<br>CUGGACAACGAAGAAAACGAAGACAUCCUGGAAGACAUCGUC<br>CUGACACUGACACUGUUCGAAGACAGAGAAAUGAUCGAAGAAAGACUGAAGA-<br>CAUACGCACACCUGUUCGACGACAAGGUCAUGAAGCAGCUG<br>AAGAAGAAGAUACAGGAUGGGGAAGACUGAGCAGAAAGCUGAUCAACGGAAUCAGA-<br>GACAAGCAGAGCGGAAAGACAAUCCUGGACUUC<br>CUGAAGAGCGACGGAUUCGCAAACAGAAACUUCAUGCAGCUGAUCCACGACGACAGC-<br>CUGACAUUCAAGGAAGACAUCCAGAAGGCACAGGUC<br>AGCGGACAGGGAGACAGCCUGCACGAACACAUCGCAAACCUGGCAGGAAGCCCGGCAAU-<br>CAAGAAGGGAAUCCUGCAGACAGUCAAGGUCGUC<br>GACGAACUGGUCAAGGUCAUGGGAAGACACAAGCCGGAAAACAUCGU-<br>CAUCGAAAUGGCAAGAGAAAACCAGACAACACAGAAGGGACAGAAG<br>AACAGCAGAGAAAGAAUGAAGAGAAUCGAAGAAGGAAUCAAGGAACUGGGAAGCCAGAUC-<br>CUGAAGGAACACCCGGUCGAAAACACACAGCUG<br>CAGAACGAAAAGCUGUACCUGUACUACCUGCAGAACGGAAGAGACAUGUACGUCGACCAG-<br>GAACUGGACAUCAACAGACUGAGCGACUACGAC<br>GUCGACGCAAUCGUCCCGCAGAGCUUCCUGAAGGACAACAGCAUCGACAACAAGGUC-<br>CUGACAAGAAGCGACAAGAACAGAGGAAAGAGCGAC<br>AACGUCCCGAGCGAAGAAGUCGUCAAGAAGAUGAAGAACUACUGGA-<br>GACAGCUGCUGAACGCAAAGCUGAUCACACAGAGAAAGUUCGACAAC<br>CUGACAAAGGCAGAGAGGAGGACUGAGCGAACUGGACAAGGCAGGAUUCAUCAAGA-<br>GACAGCUGGUCGAAACAAGACAGAUCACAAAGCAC<br>GUCGCACAGAUCCUGGACAGCAGAAUGAACACAA-<br>AGUACGACGAAAACGACAAGCUGAUCAGAGAAGUCAAGGUCAUCACACUGAAGAGCAAG<br>CUGGUCAGCGACUUCAGAAAGGACUUCCAGUUCUACAAGGUCAGAGAAAUCAACAACUAC-<br>CACCACGCACACGACGCAUACCUGAACGCAGUC<br>GUCGGAACAGCACUGAUCAAGAAGUACCCGAAGCUGGAAAGCGAAUUCGUCUACGGAGAC-<br>UACAAGGUCUACGACGUCAGAAAGAUGAUCGCA<br>AAGAGCGAACAGGAAAUCGGAAAGGCAACAGCAAAGUACUUCUUCUACAGCAACAU-<br>CAUGAACUUCUUCAAGACAGAAAUCACACUGGCAAAC<br>GGAGAAAUCAGAAAGAGACCGCUGAUCGAAACAAACGGAGAAACAGGAGAAAUCGU-<br>CUGGGACAAGGGAAGAGACUUCGCAACAGUCAGAAAG | 20 |

| Description | Sequence | SEQ ID No. |
|---|---|---|
| | GUCCUGAGCAUGCCGCAGGUCAACAUCGUCAAGAAGACAGAAGUCCAGACAGGAG-<br>GAUUCAGCAAGGAAAGCAUCCUGCCGAAGAGAAACAGC<br>GACAAGCUGAUCGCAAGAAAGAAGGACUGGGACCCGAAGAAGUACGGAG-<br>GAUUCGACAGCCCGACAGUCGCAUACAGCGUCCUGGUCGUCGCA<br>AAGGUCGAAAAGGGAAAGAGCAAGAAGCUGAAGAGCGUCAAGGAACUGCUGGGAAU-<br>CACAAUCAUGGAAAGAAGCAGCUUCGAAAAGAACCCG<br>AUCGACUUCCUGGAAGCAAAGGGAUACAAGGAAGUCAAGAAGGACCUGAUCAU-<br>CAAGCUGCCGAAGUACAGCCUGUUCGAACUGGAAAACGGA<br>AGAAAGAGAAUGCUGGCAAGCGCAGGAGAACUGCAGAAGGGAAACGAACUGGCA-<br>CUGCCGAGCAAGUACGUCAACUUCCUGUACCUGGCAAGC<br>CACUACGAAAAGCUGAAGGGAAGCCCGGAAGACAACGAACAGAAGCAGCUGUUCGU-<br>CGAACAGCACAAGCACUACCUGGACGAAAUCAUCGAA<br>CAGAUCAGCGAAUUCAGCAAGAGAGUCAUCCUGGCAGACGCAAACCUGGACAAGGUC-<br>CUGAGCGCAUACAACAAGCACAGAGACAAGCCGAUC<br>AGAGAACAGGCAGAAAACAUCAUCCACCUGUUCACACUGACAAACCUGG-<br>GAGCACCGGCAGCAUUCAAGUACUUCGACACAACAAUCGACAGA<br>AAGAGAUACACAAGCACAAAGGAAGUCCUGGACGCAACACUGAUCCACCAGAGCAU-<br>CACAGGACUGUACGAAACAAGGAAUCGACCUGAGCCAG<br>CUGGGAGGAGACUAG | |
| dCas9 coding sequence encoding SEQ ID NO: 19 using minimal uridine codons as listed in Table 3 (no start or stop codons; suitable for inclusion in fusion protein coding sequence) | GACAAGAAGUACAGCAUCGGACUGGCAAUCGGAACAAACAGCGUCGGAUGGGCAGUCAU-<br>CACAGACGAAUACAAGGUCCCGAGCAAGAAGUUC<br>AAGGUCCUGGGAAACACAGACAGACACAGCAUCAAGAAGAACCUGAUCGGAGCACUGCU-<br>GUUCGACAGCGGAGAAACAGCAGAAGCAACAAGA<br>CUGAAGAGAACAGCAAGAAGAAGAUACACAAGAAGAAAGAACAGAAUCUGCUACCUGCAG-<br>GAAAUCUUCAGCAACGAAAUGGCAAAGGUCGAC<br>GACAGCUUCUUCCACAGACUGGAAGAAGCUUCCUGGUCGAAGAA-<br>GACAAGAAGCACGAAAAGCACCCGAUCUUCGGAAACAUCGUCGACGAA<br>GUCGCAUACCACGAAAAGUACCCGACAAUCUACCACCUGAGAAAGAAGCUGGU-<br>CGACAGCACAGACAAGGCAGACCUGAGACUGAUCUACCUG<br>GCACUGGCACACAUGAUCAAGUUCAGAGGACACUUCCUGAUCGAAGGAGAC-<br>CUGAACCCGGACAACAGCGACGUCGACAAGCUGUUCAUCCAG<br>CUGGUCCAGACAUACAACCAGCUGUUCGAAGAAAACCCGAUCAACGCAAGCGGAGU-<br>CGACGCAAAGGCAAUCCUGAGCGCAAGACUGAGCAAG<br>AGCAGAAGACUGGAAAACCUGAUCGCACAGCUGCCGGGAGAAAAGAAGAACGGACU-<br>GUUCGGAAACCUGAUCGCACUGAGCCUGGGACUGACA<br>CCGAACUUCAAGAGCAACUUCGACCUGGCAGAA-<br>GACGCAAAGCUGCAGCUGAGCAAGGACACAUACGACGACGACCUGGACAACCUGCUGGCA<br>CAGAUCGGAGACCAGUACGCAGACCUGUUCCUGGCAGCAAAGAACCUGAGCGACGCAAUC-<br>CUGCUGAGCGACAUCCUGAGAGUCAACACAGAA<br>AUCACAAAGGCACCGCUGAGCGCAAGCAUGAUCAAGAGAUACGACGAACACCACCAGGAC-<br>CUGACACUGCUGAAGGCACUGGUCAGACAGCAG<br>CUGCCGGAAAAGUACAAGGAAAUCUUCUUCGACCAGAGCAAGAACGGAUACGCAGGAUA-<br>CAUCGACGGAGGAGCAAGCCAGGAAGAAUUCUAC<br>AAGUUCAUCAAGCCGAUCCUGGAAAAGAUGGACGGAACAGAAGAACUGCUGGU-<br>CAAGCUGAACAGAGAAGACCUGCUGAGAAAGCAGAGAACA<br>UUCGACAACGGAAGCAUCCCGCACCAGAUCCACCUGGGAGAACUGCACGCAAUC-<br>CUGAGAAGACAGGAAGACUUCUACCCGUUCCUGAAGGAC<br>AACAGAGAAAAGAUCGAAAAGAUCCUGACAUUCAGAAUCCCGUACUACGU-<br>CGGACCGCUGGCAAGAGGAAACAGCAGAUUCGCAUGGAUGACA<br>AGAAAGAGCGAAGAAACAAUCACACCGUGGAACUUCGAAGAAGUCGUCGACAAGG-<br>GAGCAAGCGCACAGAGCUUCAUCGAAAGAAUGACAAAC<br>UUCGACAAGAACCUGCCGAACGAAAAGGUCCUGCCGAAGCACAGCCUGCUGUACGAAUAC-<br>UUCACAGUCUACAACGAACUGACAAAGGUCAAG<br>UACGUCACAGAAGGAAUGAGAAAGCCGGCAUUCCUGAGCGGAGAACAGAAGAAGGCAAUC-<br>GUCGACCUGCUGUUCAAGACAAACAGAAAGGUC<br>ACAGUCAAGCAGCUGAAGGAAGACUACUUCAAGAAGAUCGAAUGCUUCGACAGCGU-<br>CGAAAUCAGCGGAGUCGAAGACAGAUUCAACGCAAGC<br>CUGGGAACAUACCACGACCUGCUGAAGAUCAUCAAGGACAAGGACUUC-<br>CUGGACAACGAAGAAAACGAAGACAUCCUGGAAGACAUCGUCCUG<br>ACACUGACACUGUUCGAAGACAGAGAAAUGAUCGAAGAAAGACUGAAGACAUACGCACAC-<br>CUGUUCGACGACAAGGUCAUGAAGCAGCUGAAG<br>AGAAGAAGAUACACAGGAUGGGGAAGACUGAGCAGAAAGCUGAUCAACGGAAUCAGA-<br>GACAAGCAGAGCGGAAAGACAAUCCUGGACUUCCUG<br>AAGAGCGACGGAUUCGCAAACAGAAACUUCAUGCAGCUGAUCCACGACGACAGCCUGA-<br>CAUUCAAGGAAGACAUCCAGAAGGCACAGGUCAGC<br>GGACAGGGAGACAGCCUGCACGAACACAUCGCAAACCUGGCAGGAAGCCCGGCAAU-<br>CAAGAAGGGAAUCCUGCAGACAGUCAAGGUCGUCGAC<br>GAACUGGUCAAGGUCAUGGGAAGACACAAGCCGGAAAACAUCGU-<br>CAUCGAAAUGGCAAGAGAAAACCAGACAACACAGAAGGGACAGAAGAAC<br>AGCAGAGAAAGAAUGAAGAGAAUCGAAGAGGAAUCAAGGAACUGGGAAGCCAGAUC-<br>CUGAAGGAACACCCGGUCGAAAACACACAGCUGCAG<br>AACGAAAAGCUGUACCUGUACUACCUGCAGAACGGAAGAGACAUGUACGUCGACCAG-<br>GAACUGGACAUCAACAGACUGAGCGACUACGACGUC<br>GACGCAAUCGUCCCGCAGAGCUUCCUGAAGGACGACAGCAUCGACAACAAGGUC-<br>CUGACAAGAAGCGACAAGAACAGAGGAAAGAGCGACAAC | 21 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
| --- | --- | --- |
| | GUCCCGAGCGAAGAAGUCGUCAAGAAGAUGAAGAACUACUGGA-<br>GACAGCUGCUGAACGCAAAGCUGAUCACACAGAGAAAGUUCGACAACCUG<br>ACAAAGGCAGAGAGAGGAGGACUGAGCGAACUGGACAAGGCAGGAUUCAUCAAGA-<br>GACAGCUGGUCGAAACAAGACAGAUCACAAAGCACGUC<br>GCACAGAUCCUGGACAGCAGAAUGAACACAA-<br>AGUACGACGAAAACGACAAGCUGAUCAGAGAAGUCAAGGUCAUCACACUGAAGAGCAAGCUG<br>GUCAGCGACUUCAGAAAGGACUUCCAGUUCUACAAGGUCAGAGAAAUCAACAACUACCAC-<br>CACGCACACGACGCAUACCUGAACGCAGUCGUC<br>GGAACAGCACUGAUCAAGAAGUACCCGAAGCUGGAAAGCGAAUUCGUCUACGGAGACUA-<br>CAAGGUCUACGACGUCAGAAAGAUGAUCGCAAAG<br>AGCGAACAGGAAAUCGGAAAGGCAACAGCAAAGUACUUCUUCUACAGCAACAUCAUGAAC-<br>UUCUUCAAGACAGAAAUCACACUGGCAAACGGA<br>GAAAUCAGAAAGAGACCGCUGAUCGAAACAAACGGAGAAACAGGAGAAAUCGU-<br>CUGGGACAAGGGAAGAGACUUCGCAACAGUCAGAAAGGUC<br>CUGAGCAUGCCGCAGGUCAACAUCGUCAAGAAGACAGAAGUCCAGACAGGAG-<br>GAUUCAGCAAGGAAAGCAUCCUGCCGAAGAGAAACAGCGAC<br>AAGCUGAUCGCAAGAAAGAAGGACUGGGACCCGAAGAAGUACGGAG-<br>GAUUCGACAGCCCGACAGUCGCAUACAGCGUCCUGGUCGUCGCAAAG<br>GUCGAAAAGGGAAAGAGCAAGAAGCUGAAGAGCGUCAAGGAACUGCUGGGAAUCACAAU-<br>CAUGGAAAGAAGCAGCUUCGAAAAGAACCCGAUC<br>GACUUCCUGGAAGCAAAGGGAUACAAGGAAGUCAAGAAGGACCUGAUCAU-<br>CAAGCUGCCGAAGUACAGCCUGUUCGAACUGGAAAACGGAAGA<br>AAGAGAAUGCUGGCAAGCGCAGGAGAACUGCAGAAGGGAAACGAACUGGCA-<br>CUGCCGAGCAAGUACGUCAACUUCCUGUACCUGGCAAGCCAC<br>UACGAAAAGCUGAAGGGAAGCCCGGAAGAACAACGAACAGAAGCAGCUGUUCGU-<br>CGAACAGCACAAGCACUACCUGGACGAAAUCAUCGAACAG<br>AUCAGCGAAUUCAGCAAGAGAGUCAUCCUGGCAGACGCAAACCUGGACAAGGUC-<br>CUGAGCGCAUACAACAAGCACAGAGACAAGCCGAUCAGA<br>GAACAGGCAGAAAACAUCAUCCACCUGUUCACACUGAACCUGGGAGCACCGGCAG-<br>CAUUCAAGUACUUCGACACAACAAUCGACAGAAAG<br>AGAUACACAAGCACAAAGGAAGUCCUGGACGCAACACUGAUCCACCAGAGCAU-<br>CACAGGACUGUACGAAACAAGAAUCGACCUGAGCCAGCUG<br>GGAGGAGACGGAGGAGGAAGC | |
| Amino acid sequence of Cas9 with two nuclear localization signals as the C-terminal amino acids | MDKKYSIGLDIGTNSVGWAVITDEYKVPSKKFKVLGNTDRHSIKKNLIGALLFDSGETAE-<br>ATRLKRTARRRYTRRKNRICYLQEIFSNEMAKV<br>DDSFFHRLEESFLVEEDKKHERHPIFGNIVDEVAYHEKYPTIYHLRKKLVD-<br>STDKADLRLIYLALAHMIKFRGHFLIEGDLNPDNSDVDKLFI<br>QLVQTYNQLFEENPINASGVDAKAILSARLSKSRRLENLIAQLPGEKKNGLFGNLIA-<br>LSLGLIPNFKSNFDLAEDAKLQLSKDTYDDDLDNLL<br>AQIGDQYADLFLAAKNLSDAILLSDILRVNTEITKAPLSASMIKRYDEHHQDLTLLKA-<br>LVRQQLPEKYKEIFFDQSKNGYAGYIDGGASQEEF<br>YKFIKPILEKMDGTEELLVKLNREDLLRKQRTFDNGSIPHQIHLGELHAILRRQEDFYP-<br>FLKDNREKIEKILTFRIPYYVGPLARGNSRFAWM<br>TRKSEETITPWNFEEVVDKGASAQSFIERMTNFDKNLPNEKVLPKHSLLY-<br>EYFTVYNELTKVKYVTEGMRKPAFLSGEQKKAIVDLLFKTNRK<br>VTVKQLKEDYFKKIECFDSVEISGVEDRFNASLGTYHDLLKIIKDKDFLDNEENEDILE-<br>DIVLILTLFEDREMIEERLKTYAHLFDDKVMKQL<br>KRRRYTGWGRLSRKLINGIRDKQSGKTILDFLKSDGFANRNFMQLIHDD-<br>SLTFKEDIQKAQVSGQGDSLHEHIANLAGSPAIKKGILQTVKVV<br>DELVKVMGRHKPENIVIEMARENQTTQKGQKNSRERMKRIEEGIKEL-<br>GSQILKEHPVENTQLQNEKLYLYYLQNGRDMYVDQELDINRLSDYD<br>VDHIVPQSFLKDDSIDNKVLTRSDKNRGKSDNVPSEEVVKKMKNYWRQLLNAK-<br>LITQRKFDNLTKAERGGLSELDKAGFIKRQLVETRQITKH<br>VAQILDSRMNTKYDENDKLIREVKVITLKSKLVSDFRKDFQFYKVREINNYHHAHDAYL-<br>NAVVGTALIKKYPKLESEFVYGDYKVYDVRKMIA<br>KSEQEIGKATAKYFFYSNIMNFFKTEITLANGEIRKRPLIETNGETGEIVWDKGRDFA-<br>TVRKVLSMPQVNIVKKTEVQTGGFSKESILPKRNS<br>DKLIARKKDWDPKKYGGFDSPTVAYSVLVVAKVEKGKSKKLKSVKELLGITIMERSS-<br>FEKNPIDFLEAKGYKEVKKDLIIKLPKYSLFELENG<br>RKRMLASAGELQKGNELALPSKYVNFLYLASHYEKLKGSPEDNEQKQLFVEQHKHYL-<br>DEIIEQISEFSKRVILADANLDKVLSAYNKHRDKPI<br>REQAENIIHLFTLINLGAPAAFKYFDTTIDRKRYTSTKEVLDATLIHQSITGLYETRIDLSQLGGD GSGSPKKKRKVDGSPKKKRKVDSG | 22 |
| Cas9 mRNA ORF encoding | AUGGACAAGAAGUACAGCAUCGGACUGGACAUCGGAACAAACAGCGUCGGAUGGGCAGU-<br>CAUCACAGACGAAUACAAGGUCCCGAGCAAGAAG<br>UUCAAGGUCCUGGGAAACACAGACAGACAGCAUCAAGAAGAACCUGAUCGGAGCA-<br>CUGCUGUUCGACAGCGGAGAAACAGCAGAAGCAACA<br>AGACUGAAGAGAACAGCAAGAAGAAGAUACACAAGAAGAAACAGAAUCUGCUAC-<br>CUGCAGGAAAUCUUCAGCAACGAAAUGGCAAAGGUC<br>GACGACAGCUUCUUCCACAGACUGGAAGAAAGCUUCCUGGUCGAAGAA-<br>GACAAGAAGCACGAAAGACACCCGAUCUUCGGAAACAUCGUCGAC | 23 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| SEQ ID NO: 22 using minimal uridine codons as listed in Table 3, with start and stop codons | GAAGUCGCAUACCACGAAAAGUACCCGACAAUCUACCACCUGAGAAAGAAGCUGGU-<br>CGACAGCACAGACAAGGCAGACCUGAGACUGAUCUAC<br>CUGGCACUGGCACACAUGAUCAAGUUCAGAGGACACUUCCUGAUCGAAGGAGAC-<br>CUGAACCCGGACAACAGCGACGUCGACAAGCUGUUCAUC<br>CAGCUGGUCCAGACAUACAACCAGCUGUUCGAAGAAAACCCGAUCAACGCAAGCGGAGU-<br>CGACGCAAAGGCAAUCCUGAGCGCAAGACUGAGC<br>AAGAGCAGAAGACUGGAAAACCUGAUCGCACAGCUGCCGGGAGAAAAGAAGAACGGACU-<br>GUUCGGAAACCUGAUCGCACUGAGCCUGGGACUG<br>ACACCGAACUUCAAGAGCAACUUCGACCUGGCAGAA-<br>GACGCAAAGCUGCAGCUGAGCAAGGACACAUACGACGACGACCUGGACAACCUGCUG<br>GCACAGAUCGGAGACCAGUACGCAGACCUGUUCCUGGCAGCAAAGAAC-<br>CUGAGCGACGCAAUCCUGCUGAGCGACAUCCUGAGAGUCAACACA<br>GAAAUCACAAAGGCACCGCUGAGCGCAAGCAUGAUCAAGAGAUACGACGAACAC-<br>CACCAGGACCUGACACUGCUGAAGGCACUGGUCAGACAG<br>CAGCUGCCGGAAAAGUACAAGGAAAUCUUCUUCGACCAGAGCAAGAACGGAUACGCAG-<br>GAUACAUCGACGGAGGAGCAAGCCAGGAAGAAUUC<br>UACAAGUUCAUCAAGCCGAUCCUGGAAAAGAUGGACGGAACAGAAGAACUGCUGGU-<br>CAAGCUGAACAGAGAAGACCUGCUGAGAAAGCAGAGA<br>ACAUUCGACAACGGAAGCAUCCCGCACCAGAUCCACCUGGGAGAACUGCACGCAAUC-<br>CUGAGAAGACAGGAAGACUUCUACCCGUUCCUGAAG<br>GACAACAGAGAAAAGAUCGAAAAGAUCCUGACAUUCAGAAUCCCGUACUACGU-<br>CGGACCGCUGGCAAGAGGGAAACAGCAGAUUCGCAUGGAUG<br>ACAAGAAAGAGCGAAGAAACAAUCACACCGUGGAACUUCGAAGAAGUCGUCGACAAGG-<br>GAGCAAGCGCACAGAGCUUCAUCGAAAGAAUGACA<br>AACUUCGACAAGAACCUGCCGAACGAAAAGGUCCUGCCGAAGCACAGCCUGCU-<br>GUACGAAUACUUCACAGUCUACAACGAACUGACAAAGGUC<br>AAGUACGUCACAGAAGGAAUGAGAAAGCCGGCAUUCCUGAGCG-<br>GAGAACAGAAGAAGGCAAUCGUCGACCUGCUGUUCAAGACAAACAGAAAG<br>GUCACAGUCAAGCAGCUGAAGGAAGACUACUUCAAGAAGAUCGAAUGCUUCGACAGCGU-<br>CGAAAUCAGCGGAGUCGAAGACAGAUUCAACGCA<br>AGCCUGGGAACAUACCACGACCUGCUGAAGAUCAUCAAGGACAAGGACUUC-<br>CUGGACAACGAAGAAACGAAGACAUCCUGGAAGACAUCGUC<br>CUGACACUGACACUGUUCGAAGACAGAGAAAUGAUCGAAGAAAGACUGAAGA-<br>CAUACGCACACCUGUUCGACGACAAGGUCAUGAAGCAGCUG<br>AAGAGAAGAAGAUACACAGGAUGGGGAAGACUGAGCAGAAAGCUGAUCAACGGAAUCAGA-<br>GACAAGCAGAGCGGAAAGACAAUCCUGGACUUC<br>CUGAAGAGCGACGGAUUCGCAAACAGAAACUUCAUGCAGCUGAUCCACGACGACAGC-<br>CUGACAUUCAAGGAAGACAUCCAGAAGGCACAGGUC<br>AGCGGACAGGGAGACAGCCUGCACGAACACAUCGCAAACCUGGCAGGAAGCCCGGCAAU-<br>CAAGAAGGGAAUCCUGCAGACAGUCAAGGUCGUC<br>GACGAACUGGUCAAGGUCAUGGGAAGACACAAGCCGGAAAACAUCGU-<br>CAUCGAAAUGGCAAGAGAAAACCAGACAACACAGAAGGGACAGAAG<br>AACAGCAGAGAAAGAAUGAAGAGAAUCGAAGAAGGAAUCAAGGAACUGGGAAGCCAGAUC-<br>CUGAAGGAACACCCGGUCGAAAACACACAGCUG<br>CAGAACGAAAAGCUGUACCUGUACUACCUGCAGAACGGAAGAGACAUGUACGUCGACCAG-<br>GAACUGGACAUCAACAGACUGAGCGACUACGAC<br>GUCGACCACAUCGUCCCGCAGAGCUUCCUGAAGGACGACAGCAUCGACAACAAGGUC-<br>CUGACAAGAAGCGACAAGAACAGAGGAAAGAGCGAC<br>AACGUCCCGAGCGAAGAAGUCGUCAAGAAGAUGAAGAACUACUGGA-<br>GACAGCUGCUGAACGCAAAGCUGAUCACACAGAGAAAGUUCGACAAC<br>CUGACAAAGGCAGAGAGGAGGACUGAGCGAACUGGACAAGGCAGGAUUCAUCAAGA-<br>GACAGCUGGUCGAAACAAGACAGAUCACAAAGCAC<br>GUCGCACAGAUCCUGGACAGCAGAAUGAACACAA-<br>AGUACGACGAAAACGACAAGCUGAUCAGAGAAGUCAAGGUCAUCACACUGAAGAGCAAG<br>CUGGUCAGCGACUUCAGAAAGGACUUCCAGUUCUACAAGGUCAGAGAAAUCAACAACUAC-<br>CACCACGCACACGACGCAUACCUGAACGCAGUC<br>GUCGGAACAGCACUGAUCAAGAAGUACCCGAAGCUGGAAAGCGAAUUCGUCUACGGAGAC-<br>UACAAGGUCUACGACGUCAGAAAGAUGAUCGCA<br>AAGAGCGAACAGGAAAUCGGAAAGGCAACAGCAAAGUACUUCUUCUACAGCAACAU-<br>CAUGAACUUCUUCAAGACAGAAAUCACACUGGCAAAC<br>GGAGAAAUCAGAAAGAGACCGCUGAUCGAAACAAACGGAGAAACAGGAGAAAUCGU-<br>CUGGGACAAGGGAAGAGACUUCGCAACAGUCAGAAAG<br>GUCCUGAGCAUGCCGCAGGUCAACAUCGUCAAGAAGACAGAAGUCCAGACAGGAG-<br>GAUUCAGCAAGGAAAGCAUCCUGCCGAAGAGAAACAGC<br>GACAAGCUGAUCGCAAGAAAGAAGGACUGGGACCCGAAGAAGUACGGAG-<br>GAUUCGACAGCCCGACAGUCGCAUACAGCGUCCUGGUCGUCGCA<br>AAGGUCGAAAAGGGAAAGAGCAAGAAGCUGAAGAGCGUCAAGGAACUGCUGGGAAU-<br>CACAAUCAUGGAAAGAAGCAGCUUCGAAAAGAACCCG<br>AUCGACUUCCUGGAAGCAAAGGGAUACAAGGAAGUCAAGAAGGACCUGAUCAU-<br>CAAGCUGCCGAAGUACAGCCUGUUCGAACUGGAAAACGGA<br>AGAAAGAGAAUGCUGGCAAGCGCAGGAGAACUGCAGAAGGGAAACGAACUGGCA-<br>CUGCCGAGCAAGUACGUCAACUUCCUGUACCUGGCAAGC<br>CACUACGAAAAGCUGAAGGGAAGCCCGGAAGACAACGAACAGAAGCAGCUGUUCGU-<br>CGAACAGCACAAGCACUACCUGGACGAAAUCAUCGAA<br>CAGAUCAGCGAAUUCAGCAAGAGAGUCAUCCUGGCAGACGCAAACCUGGACAAGGUC-<br>CUGAGCGCAUACAACAAGCACAGAGACAAGCCGAUC |   |

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | AGAGAACAGGCAGAAAACAUCAUCCACCUGUUCACACUGACAAACCUGG-GAGCACCGGCAGCAUUCAAGUACUUCGACACAACAAUCGACAGA AAGAGAUACACAAGCACAAAGGAAGUCCUGGACGCAACACUGAUCCACCAGAGCAU-CACAGGACUGUACGAAACAAGAAUCGACCUGAGCCAG CUGGGAGGAGACGGAAGCGGAAGCCCGAAGAAGAAGAGAAAGGUCGACGGAAGCCCGAAGAAGAAGAGAAAGGUCGACAGCGGAUAG | |
| Cas9 coding sequence encoding SEQ ID NO: 23 using minimal uridine codons as listed in Table 3 (no start or stop codons; suitable for inclusion in fusion protein coding sequence) | GACAAGAAGUACAGCAUCGGACUGGACAUCGGAACAAACAGCGUCGGAUGGGCAGUCAU-CACAGACGAAUACAAGGUCCCGAGCAAGAAGUUC AAGGUCCUGGGAAACACAGACAGACACAGCAUCAAGAAGAACCUGAUCGGAGCACUGCU-GUUCGACAGCGGAGAAACAGCAGAAGCAACAAGA CUGAAGAGAACAGCAAGAAGAAGAUACAAGAAGAAAGAACAGAAUCUGCUACCUGCAG-GAAAUCUUCAGCAACGAAAUGGCAAAGGUCGAC GACAGCUUCUUCCACAGACUGGAAGAAAGCUUCCUGGUCGAAGAA-GACAAGAAGCACAAAGACACCCGAUCUUCGGAAACAUCGUCGACGAA GUCGCAUACCACGAAAAGUACCCGACAAUCUACCACCUGAGAAAGAAGCUGGU-CGACAGCACAGACAAGGCAGACCUGAGACUGAUCUACCUG GCACUGGCACACAUGAUCAAGUUCAGAGGACACUUCCUGAUCGAAGGAGAC-CUGAACCCGGACAACAGCGACGUCGACAAGCUGUUCAUCCAG CUGGUCCAGACAUACAACCAGCUGUUCGAAGAAAACCCGAUCAACGCAAGCGGAGU-CGACGCAAAGGCAAUCCUGAGCGCAAGACUGAGCAAG AGCAGAAGACUGGAAAAUCCUGAUCGCACAGCUGCCGGGAGAAAAGAAGAACGGACU-GUUCGGAAACCUGAUCGCACUGAGCCUGGGACUGACA CCGAACUUCAAGAGCAACUUCGACCUGGCAGAA-GACGCAAAGCUGCAGCUGAGCAAGGACACAUACGACGACCUGGACAACCUGCUGGCA CAGAUCGGAGACCAGUACGCAGACCUGUUCCUGGCAGCAAAGAACCUGAGCGACGCAAUC-CUGCUGAGCGACAUCCUGAGAGUCAACACAGAA AUCACAAAGGCACCGCUGAGCGCAAGCAUGAUCAAGAGAUACGACGAACACCACCAGGAC-CUGACACUGCUGAAGGCACUGGUCAGACAGCAG CUGCCGGAAAAGUACAAGGAAAUCUUCUUCGACCAGAGCAAGAACGGAUACGCAGGAUA-CAUCGACGGAGGAGCAAGCCAGGAAGAAUUCUAC AAGUUCAUCAAGCCGAUCCUGGAAAAGAUGGACGGAACAGAAGAACUGCUGGU-CAAGCUGAACAGAGAAGACCUGCUGAGAAAGCAGAGAACA UUCGACAACGGAAGCAUCCCGCACCAGAUCCACCUGGGAGAACUGCACGCAAUC-CUGAGAAGACAGGAAGACUUCUACCCGUUCCUGAAGGAC AACAGAGAAAAGAUCGAAAAGAUCCUGACAUUCAGAAUCCCGUACUACGU-CGGACCGCUGGCAAGAGGAAACAGCAGAUUCGCAUGGAUGACA AGAAAGAGCGAAGAAACAAUCACACCGUGGAACUUCGAAGAAGUCGUCGACAAGG-GAGCAAGCGCACAGAGCUUCAUCGAAAGAAUGACAAAC UUCGACAAGAACCUGCCGAACGAAAAGGUCCUGCCGAAGCACAGCCUGCUGUACGAAUAC-UUCACAGUCUACAACGAACUGACAAAGGUCAAG UACGUCACAGAAGGAAUGAGAAAGCCGGCAUUCCUGAGCGGAGAACAGAAGAAGGCAAUC-GUCGACCUGCUGUUCAAGACAAACAGAAAGGUC ACAGUCAAGCAGCUGAAGGAAGACUACUUCAAGAAGAUCGAAUGCUUCGACAGCGU-CGAAAUCAGCGGAGUCGAAGACAGAUUCAACGCAAGC CUGGGAACAUACCACGACCUGCUGAAGAUCAUCAAGGACAAGGACUUC-CUGGACAACGAAGAAAACGAAGACAUCCUGGAAGACAUCGUCCUG ACACUGACACUGUUCGAAGACAGAGAAAUGAUCGAAGAAACUGAAGACAUACGCACAC-CUGUUCGACGACAAGGUCAUGAAGCAGCUGAAG AGAAGAAGAUACACAGGAUGGGGAAGACUGAGCAGAAAGCUGAUCAACGGAAUCAGA-GACAAGCAGAGCGGAAAGACAAUCCUGGACUUCCUG AAGAGCGACGGAUUCGCAAACAGAAACUUCAUGCAGCUGAUCCACGACGACAGCCUGA-CAUUCAAGGAAGACAUCCAGAAGGCACAGGUCAGC GGACAGGGAGACAGCCUGCACGAACACAUCGCAAACCUGGCAGGAAGCCCGGCAAU-CAAGAAGGGAAUCCUGCAGACAGUCAAGGUCGUCGAC GAACUGGUCAAGGUCAUGGGAAGACACAAGCCGGAAAACAUCGU-CAUCGAAAUGGCAAGAGAAAACCAGACAACACAGAAGGGACAGAAGAAC AGCAGAGAAAGAAUGAAGAGAAUCGAAGAAGGAAUCAAGGAACUGGGAAGCCAGAUC-CUGAAGGAACACCCGGUCGAAAACACACAGCUGCAG AACGAAAAGCUGUACCUGUACUACCUGCAGAACGGAAGAGACAUGUACGUCGACCAG-GAACUGGACAUCAACAGACUGAGCGACUACGACGUC GACCACAUCGUCCCGCAGAGCUUCCUGAAGGACGACAGCAUCGACAACAAGGUC-CUGACAAGAAGCGACAAGAACAGAGGAAAGAGCGACAAC GUCCCGAGCGAAGAAGUCGUCAAGAAGAUGAAGAACUACUGGA-GACAGCUGCUGAACGCAAAGCUGAUCACACAGAGAAAGUUCGACAACCUG ACAAAGGCAGAGAGAGGAGGACUGAGCGAACUGGACAAGGCAGGAUUCAUCAAGA-GACAGCUGGUCGAAACAAGACAGAUCACAAAGCACGUC GCACAGAUCCUGGACAGCAGAAUGAACACAA-AGUACGACGAAAACGACAAGCUGAUCAGAGAAGUCAAGGUCAUCACACUGAAGAGCAAGCUG GUCAGCGACUUCAGAAAGGACUUCCAGUUCUACAAGGUCAGAGAAAUCAACAACUACCAC-CACGCACACGACGCAUACCUGAACGCAGUCGUC GGAACAGCACUGAUCAAGAAGUACCCGAAGCUGGAAAGCGAAUUCGUCUACGGAGACUA-CAAGGUCUACGACGUCAGAAAGAUGAUCGCAAAG AGCGAACAGGAAAUCGGAAAGGCAACAGCAAAGUACUUCUUCUACAGCAACAUCAUGAAC-UUCUUCAAGACAGAAAUCACACUGGCAAACGGA GAAAUCAGAAAGAGACCGCUGAUCGAAACAAACGGAGAAACAGGAGAAAUCGU-CUGGGACAAGGGAAGAGACUUCGCAACAGUCAGAAAGGUC | 24 |

| Description | Sequence | SEQ ID No. |
|---|---|---|
| | CUGAGCAUGCCGCAGGUCAACAUCGUCAAGAAGACAGAAGUCCAGACAGGAG-<br>GAUUCAGCAAGGAAAGCAUCCUGCCGAAGAGAAACAGCGAC<br>AAGCUGAUCGCAAGAAAGAAGGACUGGGACCCGAAGAAGUACGGAG-<br>GAUUCGACAGCCCGACAGUCGCAUACAGCGUCCUGGUCGUCGCAAAG<br>GUCGAAAAGGGAAAGAGCAAGAAGCUGAAGAGCGUCAAGGAACUGCUGGGAAUCACAAU-<br>CAUGGAAAGAAGCAGCUUCGAAAAGAACCCGAUC<br>GACUUCCUGGAAGCAAAGGGAUACAAGGAAGUCAAGAAGGACCUGAUCAU-<br>CAAGCUGCCGAAGUACAGCCUGUUCGAACUGGAAAACGGAAGA<br>AAGAGAAUGCUGGCAAGCGCAGGAGAACUGCAGAAGGGAAACGAACUGGCA-<br>CUGCCGAGCAAGUACGUCAACUUCCUGUACCUGGCAAGCCAC<br>UACGAAAAGCUGAAGGGAAGCCCGGAAGACAACGAACAGAAGCAGCUGUUCGU-<br>CGAACAGCACAAGCACUACCUGGACGAAAUCAUCGAACAG<br>AUCAGCGAAUUCAGCAAGAGAGUCAUCCUGGCAGACGCAAACCUGGACAAGGUC-<br>CUGAGCGCAUACAACAAGCACAGAGACAAGCCGAUCAGA<br>GAACAGGCAGAAAACAUCAUCCACCUGUUCACACUGACAAACCUGGGAGCACCGGCAG-<br>CAUUCAAGUACUUCGACACAACAAUCGACAGAAAG<br>AGAUACACAAGCACAAAGGAAGUCCUGGACGCAACACUGAUCCACCAGAGCAU-<br>CACAGGACUGUACGAAACAAGAAUCGACCUGAGCCAGCUG<br>GGAGGAGACGGAAGCGGAAGCCCGAAGAAGAAGAGAAAGGUCGACGGAAGCCCGAAGAAGAAGAGAAAGGUCGACAGCGGA | |
| Amino acid se-<br>quence of Cas9 nick-<br>ase with two nuclear local-<br>ization signals as the C-<br>terminal amino acids | MDKKYSIGLAIGTNSVGWAVITDEYKVPSKKFKVLGNTDRHSIKKNLIGALLFDSGETAE-<br>ATRLKRTARRRYTRRKNRICYLQEIFSNEMAKV<br>DDSFFHRLEESFLVEEDKKHERHPIFGNIVDEVAYHEKYPTIYHLRKKLVD-<br>STDKADLRLIYLALAHMIKFRGHFLIEGDLNPDNSDVDKLFI<br>QLVQTYNQLFEENPINASGVDAKAILSARLSKSRRLENLIAQLPGEKKNGLFGNLIA-<br>LSLGLTPNFKSNFDLAEDAKLQLSKDTYDDDLDNLL<br>AQIGDQYADLFLAAKNLSDAILLSDILRVNTEITKAPLSASMIKRYDEHHQDLTLLKA-<br>LVRQQLPEKYKEIFFDQSKNGYAGYIDGGASQEEF<br>YKFIKPILEKMDGTEELLVKLNREDLLRKQRTFDNGSIPHQIHLGELHAILRRQEDFYP-<br>FLKDNREKIEKILTFRIPYYVGPLARGNSRFAWM<br>TRKSEETITPWNFEEVVDKGASAQSFIERMTNFDKNLPNEKVLPKHSLLY-<br>EYFTVYNELTKVKYVTEGMRKPAFLSGEQKKAIVDLLFKTNRK<br>VTVKQLKEDYFKKIECFDSVEISGVEDRFNASLGTYHDLLKIIKDKDFLDNEENEDILE-<br>DIVLTLTLFEDREMIEERLKTYAHLFDDKVMKQL<br>KRRRYTGWGRLSRKLINGIRDKQSGKTILDFLKSDGFANRNFMQLIHDD-<br>SLTFKEDIQKAQVSGQGDSLHEHIANLAGSPAIKKGILQTVKVV<br>DELVKVMGRHKPENIVIEMARENQTTQKGQKNSRERMKRIEEGIKEL-<br>GSQILKEHPVENTQLQNEKLYLYYLQNGRDMYVDQELDINRLSDYD<br>VDHIVPQSFLKDDSIDNKVLTRSDKNRGKSDNVPSEEVVKKMKNYWRQLLNAK-<br>LITQRKFDNLTKAERGGLSELDKAGFIKRQLVETRQITKH<br>VAQILDSRMNTKYDENDKLIREVKVITLKSKLVSDFRKDFQFYKVREINNYHHAHDAYL-<br>NAVVGTALIKKYPKLESEFVYGDYKVYDVRKMIA<br>KSEQEIGKATAKYFFYSNIMNFFKTEITLANGEIRKRPLIETNGETGEIVWDKGRDFA-<br>TVRKVLSMPQVNIVKKTEVQTGGFSKESILPKRNS<br>DKLIARKKDWDPKKYGGFDSPTVAYSVLVVAKVEKGKSKKLKSVKELLGITIMERSS-<br>FEKNPIDFLEAKGYKEVKKDLIIKLPKYSLFELENG<br>RKRMLASAGELQKGNELALPSKYVNFLYLASHYEKLKGSPEDNEQKQLFVEQHKHYL-<br>DEIIEQISEFSKRVILADANLDKVLSAYNKHRDKPI<br>REQAENIIHLFTLTNLGAPAAFKYFDTTIDRKRYTSTKEVLDATLIHQSITGLYETRIDLSQLGGDGSGSPKKKRKVDGSPKKKRKVDSG | 25 |
| Cas9 nick-<br>ase mRNA ORF en-<br>coding SEQ ID NO: 25 using minimal | AUGGACAAGAAGUACAGCAUCGGACUGGCAAUCGGAACAAACAGCGUCGGAUGGGCAGU-<br>CAUCACAGACGAAUACAAGGUCCCGAGCAAGAAG<br>UUCAAGGUCCUGGGAAACACAGACAGACAGCAUCAAGAAGAACCUGAUCGGAGCA-<br>CUGCUGUUCGACAGCGGAGAAACAGCAGAAGCAACA<br>AGACUGAAGAGAACAGCAAGAAGAAGAUACAAGAAGAAAGAACAGAAUCUGCUAC-<br>CUGCAGGAAAUCUUCAGCAACGAAAUGGCAAAGGUC<br>GACGACAGCUUCUUCCACAGACUGGAAGAAGCUUCCUGGUCGAAGAA-<br>GACAAGAAGCACGAAAGACACCCGAUCUUCGAAACAUCGUCGAC<br>GAAGUCGCAUACCACGAAAAGUACCCGACAAUCUACCACCUGAGAAAGAAGCUGGU-<br>CGACAGCACAGACAAGGCAGACCUGAGACUGAUCUAC<br>CUGGCACUGGCACACAUGAUCAAGUUCAGAGGACACUUCCUGAUCGAAGGAGAC-<br>CUGAACCCGGACAACAGCGACGUCGACAAGCUGUUCAUC<br>CAGCUGGUCCAGACAUACAACCAGCUGUUCGAAGAAAACCCGAUCAACGCAAGCGGAGU-<br>CGACGCAAAGGCAAUCCUGAGCGCAAGACUGAGC<br>AAGAGCAGAAGCUGGAAAACCUGAUCGCACAGCUGCCGGGAGAAAAGAAGAACGGACU-<br>GUUCGGAAACCUGAUCGCACUGAGCCUGGGACUG<br>ACACCGAACUUCAAGAGCAACUUCGACCUGGCAGAA-<br>GACGCAAAGCUGCAGCUGAGCAAGGACACAUACGACGACGACCUGGACAACCUGCUG<br>GCACAGAUCGGAGACCAGUACGCAGACCUGUUCCUGGCAGCAAAGAAC-<br>CUGAGCGACGCAAUCCUGCUGAGCGACAUCCUGAGAGUCAACACA<br>GAAAUCACAAAGGCACCGCUGAGCGCAAGCAUGAUCAAGAGAUACGACGAACAC-<br>CACCAGGACCUGACACUGCUGAAGGCACUGGUCAGACAG | 26 |

| Description | Sequence | SEQ ID No. |
|---|---|---|
| uridine codons as listed in Table 3, with start and stop codons | CAGCUGCCGGAAAAGUACAAGGAAAUCUUCUUCGACCAGAGCAAGAACGGAUACGCAG-<br>GAUACAUCGACGGAGGAGCAAGCCAGGAAGAAUUC<br>UACAAGUUCAUCAAGCCGAUCCUGGAAAAGAUGGACGGAACAGAAGAACUGCUGGU-<br>CAAGCUGAACAGAGAAGACCUGCUGAGAAAGCAGAGA<br>ACAUUCGACAACGGAAGCAUCCCGCACCAGAUCCACCUGGGAGAACUGCACGCAAUC-<br>CUGAGAAGACAGGAAGACUUCUACCCGUUCCUGAAG<br>GACAACAGAGAAAAGAUCGAAAAGAUCCUGCAUUCAGAAUCCCGUACUACGU-<br>CGGACCGCUGGCAAGAGGAAACAGCAGAUUCGCAUGGAUG<br>ACAAGAAAGAGCGAAGAAACAAUCACACCGUGGAACUUCGAAGAAGUCGUCGACAAGG-<br>GAGCAAGCGCACAGAGCUUCAUCGAAAGAAUGACA<br>AACUUCGACAAGAACCUGCCGAACGAAAAGGUCCUGCCGAAGCACAGCCUGCU-<br>GUACGAAUACUUCACAGUCUACAACGAACUGACAAAGGUC<br>AAGUACGUCACAGAAGGAAUGAGAAAGCCGGCAUUCCUGAGCG-<br>GAGAACAGAAGAAGGCAAUCGUCGACCUGCUGUUCAAGACAAACAGAAAG<br>GUCACAGUCAAGCAGCUGAAGGAAGACUACUUCAAGAAGAUCGAAUGCUUCGACAGCGU-<br>CGAAAUCAGCGGAGUCGAAGACAGAUUCAACGCA<br>AGCCUGGGAACAUACCACGACCUGCUGAAGAUCAUCAAGGACAAGGACUUC-<br>CUGGACAACGAAGAAAACGAAGACAUCCUGGAAGACAUCGUC<br>CUGACACUGACACUGUUCGAAGACAGAGAAAUGAUCGAAGAAAGACUGAAGA-<br>CAUACGCACACCUGUUCGACGACAAGGUCAUGAAGCAGCUG<br>AAGAGAAGAAGAUACACAGGAUGGGGAAGACUGAGCAGAAAGCUGAUCAACGGAAUCAGA-<br>GACAAGCAGAGCGGAAAGACAAUCCUGGACUUC<br>CUGAAGAGCGACGGAUUCGCAAACAGAAACUUCAUGCAGCUGAUCCACGACGACAGC-<br>CUGACAUUCAAGGAAGACAUCCAGAAGGCACAGGUC<br>AGCGGACAGGGAGACAGCCUGCACGAACACAUCGCAAACCUGGCAGGAAGCCCGGCAAU-<br>CAAGAAGGGAAUCCUGCAGACAGUCAAGGUCGUC<br>GACGAACUGGUCAAGGUCAUGGGAAGACACAAGCCGGAAAACAUCGU-<br>CAUCGAAAUGGCAAGAGAAAACCAGACAACACAGAAGGGACAGAAG<br>AACAGCAGAGAAAGAAUGAAGAGAAUCGAAGAAGGAAUCAAGGAACUGGGAAGCCAGAUC-<br>CUGAAGGAACACCCGGUCGAAAACACACAGCUG<br>CAGAACGAAAAGCUGUACCUGUACUACCUGCAGAACGGAAGAGACAUGUACGUCGACCAG-<br>GAACUGGACAUCAACAGACUGAGCGACUACGAC<br>GUCGACCACAUCGUCCCGCAGAGCUUCCUGAAGGACGACAGCAUCGACAACAAGGUC-<br>CUGACAAGAAGCGACAAGAACAGAGGAAAGCGAC<br>AACGUCCCGAGCGAAGAAGUCGUCAAGAAGAUGAAGAACUACUGGA-<br>GACAGCUGCUGAACGCAAAGCUGAUCACACAGAGAAAGUUCGACAAC<br>CUGACAAAGGCAGAGAGGAGGACUGAGCGAACUGGACAAGGCAGGAUUCAUCAAGA-<br>GACAGCUGGUCGAAACAAGACAGAUCACAAAGCAC<br>GUCGCACAGAUCCUGGACAGCAGAAUGAACACAA-<br>AGUACGACGAAAACGACAAGCUGAUCAGAGAAGUCAAGGUCAUCACACUGAAGAGCAAG<br>CUGGUCAGCGACUUCAGAAAGGACUUCCAGUUCUACAAGGUCAGAGAAAUCAACAACUAC-<br>CACCACGCACACGACGCAUACCUGAACGCAGUC<br>GUCGGAACAGCACUGAUCAAGAAGUACCCGAAGCUGGAAAGCGAAUUCGUCUACGGAGAC-<br>UACAAGGUCUACGACGUCAGAAAGAUGAUCGCA<br>AAGAGCGAACAGGAAAUCGGAAAGGCAACAGCAAAGUACUUCUUCUACAGCAACAU-<br>CAUGAACUUCUUCAAGACAGAAAUCACACUGGCAAAC<br>GGAGAAAUCAGAAAGAGACCGCUGAUCGAAACAAACGGAGAAAACAGGAGAAAUCGU-<br>CUGGGACAAGGGAAGAGACUUCGCAACAGUCAGAAAG<br>GUCCUGAGCAUGCCGCAGGUCAACAUCGUCAAGAAGACAGAAGUCCAGACAGGAG-<br>GAUUCAGCAAGGAAAGCAUCCUGCCGAAGAGAAACAGC<br>GACAAGCUGAUCCAAGAAAGAAGGACAUGGGACCCGAAGAAGUACGGAG-<br>GAUUCGACAGCCCGACAGUCGCAUACAGCGUCCUGGUCGUCGCA<br>AAGGUCGAAAAGGGAAAGAGCAAGAAGCUGAAGAGCGUCAAGGAACUGCUGGGAAU-<br>CACAAUCAUGGAAAGAAGCAGCUUCGAAAAGAACCCG<br>AUCGACUUCCUGGAAGCAAAGGGAUACAAGGAAGUCAAGAAGGACCUGAUCAU-<br>CAAGCUGCCGAAGUACAGCCUGUUCGAACUGGAAAACGGA<br>AGAAAGAGAAUGCUGGCAAGCGCAGGAGAACUGCAGAAGGGAAACGAACUGGCA-<br>CUGCCGAGCAAGUACGUCAACUUCCUGUACCUGGCAAGC<br>CACUACGAAAAGCUGAAGGGAAGCCCGGAAGACAACGAACAGAAGCAGCUGUUCGU-<br>CGAACAGCACAAGCACUACCUGGACGAAAUCAUCGAA<br>CAGAUCAGCGAAUUCAGCAAGAGAGUCAUCCUGGCAGACGCAAACCUGGACAAGGUC-<br>CUGAGCGCAUACAACAAGCACAGAGACAAGCCGAUC<br>AGAGAACAGGCAGAAAACAUCAUCCACCUGUUCACACUGACAAACCUGG-<br>GAGCACCGGCAGCAUUCAAGUACUUCGACACAACAUCGACAGA<br>AAGGAGAUACACAAGCACAAAGGAAGUCCUGGACGCAACACUGAUCCACCAGAGCAU-<br>CACAGGACUGUACGAAACAAGAAUCGACCUGAGCCAG<br>CUGGGAGGAGACGGAAGCGGAAGCCCGAAGAAGAAGAGAAAGGUCGACGGAAGCCCGAAGAAGAAGAGAAAGGUCGACAGCGGAUAG | |
| Cas9 nickase coding | GACAAGAAGUACAGCAUCGGACUGGCAAUCGGAACAAACAGCGUCGGAUGGGCAGUCAU-<br>CACAGACGAAUACAAGGUCCCGAGCAAGAAGUUC<br>AAGGUCCUGGGAAACACAGACAGACACAGCAUCAAGAAGAACCUGAUCGGAGCACUGCU-<br>GUUCGACAGCGGAGAAACAGCAGAAGCAACAAGA<br>CUGAAGAGAACAGCAAGAAGAAGAUACACAAGAAGAAAGAACAGAAUCUGCUACCUGCAG-<br>GAAAUCUUCAGCAACGAAAUGGCAAAGGUCGAC<br>GACAGCUUCUUCCACAGACUGGAAGAAAGCUUCCUGGUCGAAGAA-<br>GACAAGAAGCACGAAAGACACCCGAUCUUCGGAAACAUCGUCGACGAA | 27 |

-continued

Sequence Table
The following sequence table provides a listing of sequences disclosed herein. It is understood that if a DNA sequence (comprising Ts) is referenced with respect to an RNA, then Ts should be replaced with Us(which may be modified or unmodified depending on the context), and vice versa.

| Description | Sequence | SEQ ID No. |
|---|---|---|
| sequence encoding SEQ ID NO: 25 using minimal uridine codons as listed in Table 3 (no start or stop codons; suitable for inclusion in fusion protein coding sequence) | GUCGCAUACCACGAAAAGUACCCGACAAUCUACCACCUGAGAAAGAAGCUGGU-<br>CGACAGCACAGACAAGGCAGACCUGAGACUGAUCUACCUG<br>GCACUGGCACACAUGAUCAAGUUCAGAGGACACUUCCUGAUCGAAGGAGAC-<br>CUGAACCCGGACAACAGCGACGUCGACAAGCUGUUCAUCCAG<br>CUGGUCCAGACAUACAACCAGCUGUUCGAAGAAAACCCGAUCAACGCAAGCGGAGU-<br>CGACGCAAAGGCAAUCCUGAGCGCAAGACUGAGCAAG<br>AGCAGAAGACUGGAAAACCUGAUCGCACAGCUGCCGGGAGAAAAGAAGAACGGACU-<br>GUUCGGAAACCUGAUCGCACUGAGCCUGGGACUGACA<br>CCGAACUUCAAGAGCAACUUCGACCUGGCAGAA-<br>GACGCAAAGCUGCAGCUGAGCAAGGACACAUACGACGACGACCUGGACAACCUGCUGGCA<br>CAGAUCGGAGACCAGUACGCAGACCUGUUCCUGGCAGCAAAGAACCUGAGCGACGCAAUC-<br>CUGCUGAGCGACAUCCUGAGAGUCAACACAGAA<br>AUCACAAAGGCACCGCUGAGCGCAAGCAUGAUCAAGAGAUACGACGAACACCACCAGGAC-<br>CUGACACUGCUGAAGGCACUGGUCAGACAGCAG<br>CUGCCGGAAAAGUACAAGGAAAUCUUCUUCGACCAGAGCAAGAACGGAUACGCAGGAUA-<br>CAUCGACGGAGGAGCAAGCCAGGAAGAAUUCUAC<br>AAGUUCAUCAAGCCGAUCCUGGAAAAGAUGGACGGAACAGAAGAACUGCUGGU-<br>CAAGCUGAACAGAGAAGACCUGCUGAGAAAGCAGAGAACA<br>UUCGACAACGGAAGCAUCCCGCACCAGAUCCACCUGGGAGAACUGCACGCAAUC-<br>CUGAGAAGACAGGAAGACUUCUACCCGUUCCUGAAGGAC<br>AACAGAGAAAAGAUCGAAAAGAUCCUGACAUUCAGAAUCCCGUACUACGU-<br>CGGACCGCUGGCAAGAGGAAACAGCAGAUUCGCAUGGAUGACA<br>AGAAAGAGCGAAGAAACAAUCACACCGUGGAACUUCGAAGAAGUCGUCGACAAGG-<br>GAGCAAGCGCACAGAGCUUCAUCGAAAGAAUGACAAAC<br>UUCGACAAGAACCUGCCGAACGAAAAGGUCCUGCCGAAGCACAGCCUGCUGUACGAAUAC-<br>UUCACAGUCUACAACGAACUGACAAAGGUCAAG<br>UACGUCACAGAAGGAAUGAGAAAGCCGGCAUUCCUGAGCGGAGAACAGAAGAAGGCAAUC-<br>GUCGACCUGCUGUUCAAGACAAACAGAAAGGUC<br>ACAGUCAAGCAGCUGAAGGAAGACUACUUCAAGAAGAUCGAAUGCUUCGACAGCGU-<br>CGAAAUCAGCGGAGUCGAAGACAGAUUCAACGCAAGC<br>CUGGGAACAUACCACGACCUGCUGAAGAUCAUCAAGGACAAGGACUUC-<br>CUGGACAACGAAGAAAACGAAGACAUCCUGGAAGACAUCGUCCUG<br>ACACUGACACUGUUCGAAGACAGAGAAAUGAUCGAAGAAAGACUGAAGACAUACGCACAC-<br>CUGUUCGACGACAAGGUCAUGAAGCAGCUGAAG<br>AGAAGAAGAUACACAGGAUGGGGAAGACUGAGCAGAAAGCUGAUCAACGGAAUCAGA-<br>GACAAGCAGAGCGGAAAGACAAUCCUGGACUUCCUG<br>AAGAGCGACGGAUUCGCAAACAGAAACUUCAUGCAGCUGAUCCACGACGACAGCCUGA-<br>CAUUCAAGGAAGACAUCCAGAAGGCACAGGUCAGC<br>GGACAGGGAGACAGCCUGCACGAACACAUCGCAAACCUGGCAGGAAGCCCGGCAAU-<br>CAAGAAGGGAAUCCUGCAGACAGUCAAGGUCGUCGAC<br>GAACUGGUCAAGGUCAUGGGAAGACACAAGCCGGAAAACAUCGU-<br>CAUCGAAAUGGCAAGAGAAAACCAGACAACACAGAAGGGACAGAAGAAC<br>AGCAGAGAAAGAAUGAAGAGAAUCGAAGAAGGAAUCAAGGAACUGGGAAGCCAGAUC-<br>CUGAAGGAACACCCGGUCGAAAACACACAGCUGCAG<br>AACGAAAAGCUGUACCUGUACUACCUGCAGAACGGAAGAGACAUGUACGUCGACCAG-<br>GAACUGGACAUCAACAGACUGAGCGACUACGACGUC<br>GACCACAUCGUCCCGCAGAGCUUCCUGAAGGACGACAGCAUCGACAACAAGGUC-<br>CUGACAAGAAGCGACAAGAACAGAGGAAAGAGCGACAAC<br>GUCCCGAGCGAAGAAGUCGUCAAGAAGAUGAAGAACUACUGGA-<br>GACAGCUGCUGAACGCAAAGCUGAUCACACAGAGAAAGUUCGACAACCUG<br>ACAAAGGCAGAGAGAGGAGGACUGAGCGAACUGGACAAGGCAGGAUUCAUCAAGA-<br>GACAGCUGGUCGAAACAAGACAGAUCACAAAGCACGUC<br>GCACAGAUCCUGGACAGCAGAAUGAACACAA-<br>AGUACGACGAAAACGACAAGCUGAUCAGAGAAGUCAAGGUCAUCACACUGAAGAGCAAGCUG<br>GUCAGCGACUUCAGAAAGGACUUCCAGUUCUACAAGGUCAGAGAAAUCAACAACUACCAC-<br>CACGCACACGACGCAUACCUGAACGCAGUCGUC<br>GGAACAGCACUGAUCAAGAAGUACCCGAAGCUGGAAAGCGAAUUCGUCUACGGAGACUA-<br>CAAGGUCUACGACGUCAGAAAGAUGAUCGCAAAG<br>AGCGAACAGGAAAUCGGAAAGGCAACAGCAAAGUACUUCUUCUACAGCAACAUCAUGAAC-<br>UUCUUCAAGACAGAAAUCACACUGGCAAACGGA<br>GAAAUCAGAAAGAGACCGCUGAUCGAAACAAACGGAGAAACAGGAGAAAUCGU-<br>CUGGGACAAGGGAAGAGACUUCGCAACAGUCAGAAAGGUC<br>CUGAGCAUGCCGCAGGUCAACAUCGUCAAGAAGACAGAAGUCCAGACAGGAG-<br>GAUUCAGCAAGGAAAGCAUCCUGCCGAAGAGAAACAGCGAC<br>AAGCUGAUCGCAAGAAAGAAGGACUGGGACCCGAAGAAGUACGGAG-<br>GAUUCGACAGCCCGACAGUCGCAUACAGCGUCCUGGUCGUCGCAAAG<br>GUCGAAAAGGGAAAGAGCAAGAAGCUGAAGAGCGUCAAGGAACUGCUGGGAAUCACAAU-<br>CAUGGAAAGAAGCAGCUUCGAAAAGAACCCGAUC<br>GACUUCCUGGAAGCAAAGGGAUACAAGGAAGUCAAGAAGGACCUGAUCAU-<br>CAAGCUGCCGAAGUACAGCCUGUUCGAACUGGAAAACGGAAGA<br>AAGAGAAUGCUGGCAAGCGCAGGAGAACUGCAGAAGGGAAACGAACUGGCA-<br>CUGCCGAGCAAGUACGUCAACUUCCUGUACCUGGCAAGCCAC<br>UACGAAAAGCUGAAGGGAAGCCCGGAAGACAACGAACAGAAGCAGCUGUUCGU-<br>CGAACAGCACAAGCACUACCUGGACGAAAUCAUCGAACAG<br>AUCAGCGAAUUCAGCAAGAGAGUCAUCCUGGCAGACGCAAACCUGGACAAGGUC-<br>CUGAGCGCAUACAACAAGCACAGAGACAAGCCGAUCAGA | |

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | GAACAGGCAGAAAACAUCAUCCACCUGUUCACACUGACAAACCUGGGAGCACCGGCAG-<br>CAUUCAAGUACUUCGACACAACAAUCGACAGAAAG<br>AGAUACACAAGCACAAAGGAAGUCCUGGACGCAACACUGAUCCACCAGAGCAU-<br>CACAGGACUGUACGAAACAAGAAUCGACCUGAGCCAGCUG<br>GGAGGAGAC GGAAGCGGAAGCCCGAAGAAGAAGAGAAAGGUCGACGGAAGCCCGAAGAAGAAGAGAAAGGUCGACAGCGGA | |
| Amino acid sequence of dCas9 with two nuclear localization signals as the C-terminal amino acids | MDKKYSIGLAIGTNSVGWAVITDEYKVPSKKFKVLGNTDRHSIKKNLIGALLFDSGETAE-<br>ATRLKRTARRRYTRRKNRICYLQEIFSNEMAKV<br>DDSFFHRLEESFLVEEDKKHERHPIFGNIVDEVAYHEKYPTIYHLRKKLVD-<br>STDKADLRLIYLALAHMIKFRGHFLIEGDLNPDNSDVDKLFI<br>QLVQTYNQLFEENPINASGVDAKAILSARLSKSRRLENLIAQLPGEKKNGLFGNLIA-<br>LSLGLTPNFKSNFDLAEDAKLQLSKDTYDDDLDNLL<br>AQIGDQYADLFLAAKNLSDAILLSDILRVNTEITKAPLSASMIKRYDEHHQDLTLLKA-<br>LVRQQLPEKYKEIFFDQSKNGYAGYIDGGASQEEF<br>YKFIKPILEKMDGTEELLVKLNREDLLRKQRTFDNGSIPHQIHLGELHAILRRQEDFYP-<br>FLKDNREKIEKILTFRIPYYVGPLARGNSRFAWM<br>TRKSEETITPWNFEEVVDKGASAQSFIERMTNFDKNLPNEKVLPKHSLLY-<br>EYFTVYNELTKVKYVTEGMRKPAFLSGEQKKAIVDLLFKTNRK<br>VTVKQLKEDYFKKIECFDSVEISGVEDRFNASLGTYHDLLKIIKDKDFLDNEENEDILE-<br>DIVLTLTLFEDREMIEERLKTYAHLFDDKVMKQL<br>KRRRYTGWGRLSRKLINGIRDKQSGKTILDFLKSDGFANRNFMQLIHDD-<br>SLTFKEDIQKAQVSGQGDSLHEHIANLAGSPAIKKGILQTVKVV<br>DELVKVMGRHKPENIVIEMARENQTTQKGQKNSRERMKRIEEGIKEL-<br>GSQILKEHPVENTQLQNEKLYLYYLQNGRDMYVDQELDINRLSDYD<br>VDAIVPQSFLKDDSIDNKVLTRSDKNRGKSDNVPSEEVVKKMKNYWRQLLNAK-<br>LITQRKFDNLTKAERGGLSELDKAGFIKRQLVETRQITKH<br>VAQILDSRMNTKYDENDKLIREVKVITLKSKLVSDFRKDFQFYKVREINNYHHAHDAYL-<br>NAVVGTALIKKYPKLESEFVYGDYKVYDVRKMIA<br>KSEQEIGKATAKYFFYSNIMNFFKTEITLANGEIRKRPLIETNGETGEIVWDKGRDFA-<br>TVRKVLSMPQVNIVKKTEVQTGGFSKESILPKRNS<br>DKLIARKKDWDPKKYGGFDSPTVAYSVLVVAKVEKGKSKKLKSVKELLGITIMERSS-<br>FEKNPIDFLEAKGYKEVKKDLIIKLPKYSLFELENG<br>RKRMLASAGELQKGNELALPSKYVNFLYLASHYEKLKGSPEDNEQKQLFVEQHKYL-<br>DEIIEQISEFSKRVILADANLDKVLSAYNKHRDKPI<br>REQAENIIHLFTLTNLGAPAAFKYFDTTIDRKRYTSTKEVLDATLIHQSITGLYETRIDLSQLGGDGSGSPKKKRKVDGSPKKKRKVDSG | 28 |
| dCas9 mRNA ORF encoding SEQ ID NO: 28 using minimal uridine codons as listed in Table 3, with start and | AUGGACAAGAAGUACAGCAUCGGACUGGCAAUCGGAACAAACAGCGUCGGAUGGGCAGU-<br>CAUCACAGACGAAUACAAGGUCCCGAGCAAGAAG<br>UUCAAGGUCCUGGGAAACACAGACAGACACAGCAUCAAGAAGAACCUGAUCGGAGCA-<br>CUGCUGUUCGACAGCGGAGAAACAGCAGAAGCAACA<br>AGACUGAAGAGAACAGCAAGAAGAAGAUACACAAGAGAAAGAACAGAAUCUGCUAC-<br>CUGCAGGAAAUCUUCAGCAACGAAAUGGCAAAGGUC<br>GACGACAGCUUCUUCCACAGACUGGAAGAAGCUUCCUGGUCGAAGAA-<br>GACAAGAAGCACGAAAGACACCCGAUCUUCGGAAACAUCGUCGAC<br>GAAGUCGCAUACCACGAAAAGUACCCGACAAUCUACCACCUGAGAAAGAAGCUGGU-<br>CGACAGCACAGACAAGGCAGACCUGAGACUGAUCUAC<br>CUGGCACUGGCACACAUGAUCAAGUUCAGAGGACACUUCCUGAUCGAAGGAGAC-<br>CUGAACCCGGACAACAGCGACGUCGACAAGCUGUUCAUC<br>CAGCUGGUCCAGACAUACAACCAGCUGUUCGAAGAAAACCCGAUCAACGCAAGCGGAGU-<br>CGACGCAAAGGCAAUCCUGAGCGCAAGACUGAGC<br>AAGAGCAGAAGACUGGAAAACCUGAUCGCACAGCUGCCGGGAGAAAAGAAGAACGGACU-<br>GUUCGGAAACCUGAUCGCACUGAGCCUGGGACUG<br>ACACCGAACUUCAAGAGCAACUUCGACCUGGCAGAA-<br>GACGCAAAGCUGCAGCUGAGCAAGGACACAUACGACGACGACCUGGACAACCUGCUG<br>GCACAGAUCGGAGACCAGUACGCAGACCUGUUCCUGGCAGCAAAGAAC-<br>CUGAGCGACGCAAUCCUGCUGAGCGACAUCCUGAGAGUCAACACA<br>GAAAUCACAAAGGCACCGCUGAGCGCAAGCAUGAUCAAGAGAUACGACGAACAC-<br>CACCAGGACCUGACACUGCUGAAGGCACUGGUCAGACAG<br>CAGCUGCCGGAAAAGUACAAGGAAAUCUUCUUCGACCAGAGCAAGAACGGAUACGCAG-<br>GAUACAUCGACGGAGGAGCAAGCCAGGAAGAAUUC<br>UACAAGUUCAUCAAGCCGAUCCUGGAAAAGAUGGACGGAACAGAAGAACUGCUGGU-<br>CAAGCUGAACAGAGAAGACCUGCUGAGAAAGCAGAGA<br>ACAUUCGACAACGGAAGCAUCCCGCACCAGAUCCACCUGGGAGAACUGCACGCAAUC-<br>CUGAGAAGACAGGAAGACUUCUACCCGUUCCUGAAG<br>GACAACAGAGAAAAGAUCGAAAAGAUCCUGACAUUCAGAAUCCCGUACUACGU-<br>CGGACCGCUGGCAAGAGGAAACAGCAGAUUCGCAUGGAUG<br>ACAAGAAAGAGCGAAGAAACAAUCACACCGUGGAACUUCGAAGAAGUCGUCGACAAGG-<br>GAGCAAGCGCACAGAGCUUCAUCGAAAGAAUGACA<br>AACUUCGACAAGAACCUGCCGAACGAAAAGGUCCUGCCGAAGCACAGCCUGCU-<br>GUACGAAUACUUCACAGUCUACAACGAACUGACAAAGGUC<br>AAGUACGUCACAGAAGGAAUGAGAAAGCCGGCAUUCCUGAGCG-<br>GAGAACAGAAGAAGGCAAUCGUCGACCUGCUGUUCAAGACAAACAGAAAG<br>GUCACAGUCAAGCAGCUGAAGGAAGACUACUUCAAGAAGAUCGAAUGCUUCGACAGCGU-<br>CGAAAUCAGCGGAGUCGAAGACAGAUUCAACGCA | 29 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| stop codons | AGCCUGGGAACAUACCACGACCUGCUGAAGAUCAUCAAGGACAAGGACUUC-CUGGACAACGAAGAAAACGAAGACAUCCUGGAAGACAUCGUC CUGACACUGACACUGUUCGAAGACAGAGAAAUGAUCGAAGAAAGACUGAAGA-CAUACGCACACCUGUUCGACGACAAGGUCAUGAAGCAGCUG AAGGAGAAGAAGAUCACAGGAUGGGGAAGACUGAGCAGAAAGCUGAUCAACGGAAUCAGA-GACAAGCAGAGCGGAAAGACAAUCCUGGACUUC CUGAAGAGCGACGGAUUCGCAAACAGAAACUUCAUGCAGCUGAUCCACGACGACAGC-CUGACAUUCAAGGAAGACAUCCAGAAGGCACAGGUC AGCGGACAGGGAGACAGCCUGCACGAACACAUCGCAAACCUGGCAGGAAGCCCGGCAAU-CAAGAAGGGAAUCCUGCAGACAGUCAAGGUCGUC GACGAACUGGUCAAGGUCAUGGGAAGACACAAGCCGGAAAACAUCGU-CAUCGAAAUGGCAAGAGAAACCAGACAACACAGAAGGGACAGAAG AACAGCAGAGAAAGAAUGAAGAGAAUCGAAGAAGGAAUCAAGGAACUGGGAAGCCAGAUC-CUGAAGGAACACCCGUCGAAAACACAGCUG CAGAACGAAAAGCUGUACCUGUACUACCUGCAGAACGGAAGAGACAUGUACGUCGACCAG-GAACUGGACAUCAACAGACUGAGCGACUACGAC GUCGACGCAAUCGUCCCGCAGAGCUUCCUGAAGGACGACAGCAUCGACAACAAGGUC-CUGACAAGAAGCGACAAGAACAGAGGAAAGAGCGAC AACGUCCCGAGCGAAGAAGUCGUCAAGAAGAUGAAGAACUACUGGA-GACAGCUGCUGAACGCAAAGCUGAUCACACAGAGAAAGUUCGACAAC CUGACAAAGGCAGAGAGAGGAGGACUGAGCGAACUGGACAAGGCAGGAUUCAUCAAGA-GACAGCUGGUCGAAACAAGACAGAUCACAAAGCAC GUCGCACAGAUCCUGGACAGCAGAAUGAACACAA-AGUACGACGAAAACGACAAGCUGAUCAGAGAAGUCAAGGUCAUCACACUGAAGAGCAAG CUGGUCAGCGACUUCAGAAAGGACUUCCAGUUCUACAAGGUCAGAGAAAUCAACAACUAC-CACCACGCACACGACGCAUACCUGAACGCAGUC GUCGGAACAGCACUGAUCAAGAAGUACCCGAAGCUGGAAAGCGAAUUCGUCUACGGAGAC-UACAAGGUCUACGACGUCAGAAAGAUGAUCGCA AAGAGCGAACAGGAAAUCGGAAAGGCAACAGCAAAGUACUUCUUCUACAGCAACAU-CAUGAACUUCUUCAAGACAGAAAUCACACUGGCAAAC GGAGAAAUCAGAAAGAGACCGCUGAUCGAAACAAACGGAGAAACAGGAGAAAUCGU-CUGGGACAAGGGAAGAGACUUCGCAACAGUCAGAAAG GUCCUGAGCAUGCCGCAGGUCAACAUCGUCAAGAAGACAGAAGUCCAGACAGGAG-GAUUCAGCAAGGAAAGCAUCCUGCCGAAGAGAAACAGC GACAAGCUGAUCGCAAGAAAGAAGGACUGGGACCCGAAGAAGUACGGAG-GAUUCGACAGCCCGACAGUCGCAUACAGCGUCCUGGUCGUCGCA AAGGUCGAAAAGGGAAAGAGCAAGAAGCUGAAGAGCGUCAAGGAACUGCUGGGAAU-CACAAUCAUGGAAAGAAGCAGCUUCGAAAAGAACCCG AUCGACUUCCUGGAAGCAAAGGGAUACAAGGAAGUCAAGAAGGACCUGAUCAU-CAAGCUGCCGAAGUACAGCCUGUUCGAACUGGAAAACGGA AGAAAGAGAAUGCUGGCAAGCGCAGGAGAACUGCAGAAGGGAAACGAACUGGCA-CUGCCGAGCAAGUACGUCAACUUCCUGUACCUGGCAAGC CACUACGAAAAGCUGAAGGGAAGCCCGGAAGACAACGAACAGAAGCAGCUGUUCGU-CGAACAGCACAAGCACUACCUGGACGAAAUCAUCGAA CAGAUCAGCGAAUUCAGCAAGAGAGUCAUCCUGGCAGACGCAAACCUGGACAAGGUC-CUGAGCGCAUACAACAAGCACAGAGACAAGCCGAUC AGAGAACAGGCAGAAAACAUCAUCCACCUGUUCACACUGACAAACCUGG-GAGCACCGGCAGCAUUCAAGUACUUCGACACAACAAUCGACAGA AAGAGAUACACAAGCACAAAGGAAGUCCUGGACGCAACACUGAUCCACCAGAGCAU-CACAGGACUGUACGAAACAAGAAUCGACCUGAGCCAG CUGGGAGGAGAC GGAAGCGGAAGCCCGAAGAAGAAGAGAAAGGUCGACGGAAGCCCGAAGAAGAAGAGAAAGGUCGACAGCGGAUAG | |
| dCas9 coding sequence encoding SEQ ID NO: 28 using minimal uridine codons | GACAAGAAGUACAGCAUCGACUGGCAAUCGAACAAACAGCGUCGGAUGGGCAGUCAU-CACAGACGAAUACAAGGUCCCGAGCAAGAAGUUC AAGGUCCUGGGAAACACAGACAGACAGCAUCAAGAAGAACCUGAUCGGAGCACUGCU-GUUCGACAGCGGAGAAACAGCAGAAGCAACAAGA CUGAAGAGAACAGCAAGAAGAAGAUACACAAGAAGAAAGAACAGAAUCUGCUACCUGCAG-GAAAUCUUCAGCAACGAAAUGGCAAAGGUCGAC GACAGCUUCUUCCACAGACUGGAAGAAAGCUUCCUGGUCGAAGAA-GACAAGAAGCACGAAGACACCCGAUCUUCGAAACAUCGUCGACGAA GUCGCAUACCACGAAAAGUACCCGACAAUCUACCACCUGAGAAAGAAGCUGGU-CGACAGCACAGACAAGGCAGACCUGAGACUGAUCUACCUG GCACUGGCACACAUGAUCAAGUUCAGAGGACACUUCCUGAUCGAAGGAGAC-CUGAACCCGGACAACAGCGACGUCGACAAGCUGUUCAUCCAG CUGGUCCAGACAUACAACCAGCUGUUCGAAGAAAACCCGAUCAACGCAAGCGGAGU-CGACGCAAAGGCAAUCCUGAGCGCAAGACUGAGCAAG AGCAGAAGACUGGAAAACCUGAUCGCACAGCUGCCGGGAGAAAAGAAGAACGGACU-GUUCGGAAACCUGAUCGCACUGAGCCUGGGACUGACA CCGAACUUCAAGAGCAACUUCGACCUGGCAGAA-GACGCAAAGCUGCAGCUGAGCAAGGACACAUACGACGACGACCUGGACAACCUGCUGGCA CAGAUCGGAGACCAGUACGCAGACCUGUUCCUGGCAGCAAAGAACCUGAGCGACGCAAUC-CUGCUGAGCGACAUCCUGAGAGUCAACACAGAA AUCACAAAGGCACCGCUGAGCGCAAGCAUGAUCAAGAGAUACGACGAACACCACCAGGAC-CUGACACUGCUGAAGGCACUGGUCAGACAGCAG CUGCCGGAAAAGUACAAGGAAAUCUUCUUCGACCAGAGCAAGAACGGAUACGCAGGAUA-CAUCGACGGAGGAGCAAGCCAGGAAGAAUUCUAC | 30 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| as listed in Table 3 (no start or stop codons; suitable for inclusion in fusion protein coding sequence) | AAGUUCAUCAAGCCGAUCCUGGAAAAGAUGGACGGAACAGAAGAACUGCUGGU-CAAGCUGAACAGAGAAGACCUGCUGAGAAAGCAGAGAACA UUCGACAACGGAAGCAUCCCGCACCAGAUCCACCUGGGAGAACUGCACGCAAUC-CUGAGAAGACAGGAAGACUUCUACCCGUUCCUGAAGGAC AACAGAGAAAAGAUCGAAAAGAUCCUGACAUUCAGAAUCCCGUACUACGU-CGGACCGCUGGCAAGAGGAAACAGCAGAUUCGCAUGGAUGACA AGAAAGAGCGAAGAAACAAUCACACCGUGGAACUUCGAAGAAGUCGUCGACAAGG-GAGCAAGCGCACAGAGCUUCAUCGAAAGAAUGACAAAC UUCGACAAGAACCUGCCGAACGAAAAGGUCCUGCCGAAGCACAGCCUGCUGUACGAAUAC-UUCACAGUCUACAACGAACUGACAAAGGUCAAG UACGUCACAGAAGGAAUGAGAAAGCCGGCAUUCCUGAGCGGAGAACAGAAGAAGGCAAUC-GUCGACCUGCUGUUCAAGACAAACAGAAAGGUC ACAGUCAAGCAGCUGAAGGAAGACUACUUCAAGAAGAUCGAAUGCUUCGACAGCGU-CGAAAUCAGCGGAGUCGAAGACAGAUUCAACGCAAGC CUGGGAACAUACCACGACCUGCUGAAGAUCAUCAAGGACAAGGACUUC-CUGGACAACGAAGAAAACGAAGACAUCCUGGAAGACAUCGUCCUG ACACUGACACUGUUCGAAGACAGAGAAAUGAUCGAAGAAAAGACUGAAGACAUACGCACAC-CUGUUCGACGACAAGGUCAUGAAGCAGCUGAAG AGAAGAAGAUACACAGGAUGGGGAAGACUGAGCAGAAAGCUGAUCAACGGAAUCAGA-GACAAGCAGAGCGGAAAGACAAUCCUGGACUUCCUG AAGAGCGACGGAUUCGCAAACAGAAACUUCAUGCAGCUGAUCCACGACGACAGCCUGA-CAUUCAAGGAAGACAUCCAGAAGGCACAGGUCAGC GGACAGGGAGACAGCCUGCACGAACACAUCGCAAACCUGGCAGGAAGCCCGGCAAU-CAAGAAGGGAAUCCUGCAGACAGUCAAGGUCGUCGAC GAACUGGUCAAGGUCAUGGGAAGACACAAGCCGGAAAACAUCGU-CAUCGAAAUGGCAAGAGAAAACCAGACAACACAGAAGGGACAGAAGAAC AGCAGAGAAAGAAUGAAGAGAAUCGAAGAAGGAAUCAAGGAACUGGGAAGCCAGAUC-CUGAAGGAACACCCGGUCGAAAACACACAGCUGCAG AACGAAAAGCUGUACCUGUACUACCUGCAGAACGGAAGAGACAUGUACGUCGACCAG-GAACUGGACAUCAACAGACUGAGCGACUACGACGUC GACGCAAUCGUCCCGCAGAGCUUCCUGAAGGACGACAGCAUCGACAACAAGGUC-CUGACAAGAAGCGACAAGAACAGAGGAAAGAGCGACAAC GUCCCGAGCGAAGAAGUCGUCAAGAAGAUGAAGAACUACUGGA-GACAGCUGCUGAACGCAAAGCUGAUCACACAGAGAAAGUUCGACAACCUG ACAAAGGCAGAGAGAGGAGGACUGAGCGAACUGGACAAGGCAGGAUUCAUCAAGA-GACAGCUGGUCGAAACAAGACAGAUCACAAAGCACGUC GCACAGAUCCUGGACAGCAGAAUGAACACAA-AGUACGACGAAAACGACAAGCUGAUCAGAGAAGUCAAGGUCAUCACACUGAAGAGCAAGCUG GUCAGCGACUUCAGAAAGGACUUCCAGUUCUACAAGGUCAGAGAAAUCAACAACUACCAC-CACGCACACGACGCAUACCUGAACGCAGUCGUC GGAACAGCACUGAUCAAGAAGUACCCGAAGCUGGAAAGCGAAUUCGUCUACGGAGACUA-CAAGGUCUACGACGUCAGAAAGAUGAUCGCAAAG AGCGAACAGGAAAUCGGAAAGGCAACAGCAAAGUACUUCUUCUACAGCAACAUCAUGAAC-UUCUUCAAGACAGAAAUCACACUGGCAAACGGA GAAAUCAGAAAGAGACCGCUGAUCGAAACAAACGGAGAAACAGGAGAAAUCGU-CUGGGACAAGGGAAGAGACUUCGCAACAGUCAGAAAGGUC CUGAGCAUGCCGCAGGUCAACAUCGUCAAGAAGACAGAAGUCCAGACAGGAG-GAUUCAGCAAGGAAAGCAUCCUGCCGAAGAGAAACAGCGAC AAGCUGAUCGCAAGAAAGAAGGACUGGGACCCGAAGAAGUACGGAG-GAUUCGACAGCCCGACAGUCGCAUACAGCGUCCUGGUCGUCGCAAAG GUCGAAAAGGGAAAGAGCAAGAAGCUGAAGAGCGUCAAGGAACUGCUGGGAAUCACAAU-CAUGGAAAGAAGCAGCUUCGAAAAGAACCCGAUC GACUUCCUGGAAGCAAAGGGAUACAAGGAAGUCAAGAAGGACCUGAUCAU-CAAGCUGCCGAAGUACAGCCUGUUCGAACUGGAAAACGGAAGA AAGAGAAUGCUGGCAAGCGCAGGAGAACUGCAGAAGGGAAACGAACUGGCA-CUGCCGAGCAAGUACGUCAACUUCCUGUACCUGGCAAGCCAC UACGAAAAGCUGAAGGGAAGCCCGGAAGACAACGAACAGAAGCAGCUGUUCGU-CGAACAGCACAAGCACUACCUGGACGAAAUCAUCGAACAG AUCAGCGAAUUCAGCAAGAGAGUCAUCCUGGCAGACGCAAACCUGGACAAGGUC-CUGAGCGCAUACAACAAGCACAGAGACAAGCCGAUCAGA GAACAGGCAGAAAACAUCAUCCACCUGUUCACACUGACAAACCUGGGAGCACCGGCAG-CAUUCAAGUACUUCGACACAACAAUCGACAGAAAG AGAUACACAAGCACAAAGGAAGUCCUGGACGCAACACUGAUCCACCAGAGCAU-CACAGGACUGUACGAAACAAGAAUCGACCUGAGCCAGCUG GGAGGAGAC GGAAGCGGAAGCCCGAAGAAGAAGAGAAAGGUCGACGGAAGCCCGAAGAAGAAGAGAAAGGUCGACAGCGGA | |
| T7 promoter | TAATACGACTCACTATA | 31 |
| Human beta-globin 5' UTR | ACATTTGCTTCTGACACAACTGTGTTCACTAGCAACCTCAAACAGACACC | 32 |

-continued

Sequence Table
The following sequence table provides a listing of sequences disclosed herein. It is understood that if a DNA sequence (comprising Ts) is referenced with respect to an RNA, then Ts should be replaced with Us(which may be modified or unmodified depending on the context), and vice versa.

| Description | Sequence | SEQ ID No. |
|---|---|---|
| Human beta-globin 3' UTR | GCTCGCTTTCTTGCTGTCCAATTTCTATTAAAGGTTCCTTTGTTCCCTAAGTCCAACTACTAAACTGGGGGATATTATGAAGGGCCTTGAGCATCTGGATTCTGCCTAATAAAAAACATTTATTTTCATTGC | 33 |
| Human alpha-globin 5' UTR | CATAAACCCTGGCGCGCTCGCGGCCCGGCACTCTTCTGGTCCCCACAGACTCAGAGAGAACCCACC | 34 |
| Human alpha-globin 3' UTR | GCTGGAGCCTCGGTGGCCATGCTTCTTGCCCCTTGGGCCTCCCCCCAGCCCCTCCTCCCCTTCCTGCACCCGTACCCCCGTGGTCTTTGAATAAAGTCTGAGTGGGCGGC | 35 |
| *Xenopus laevis* beta-globin 5' UTR | AAGCTCAGAATAAACGCTCAACTTTGGCC | 36 |
| *Xenopus laevis* beta-globin 3' UTR | ACCAGCCTCAAGAACACCCGAATGGAGTCTCTAAGCTACATAATACCAACTTACACTTTACAAAATGTTGTCCCCAAAATGTAGCCATTCGTATCTGCTCCTAATAAAAAGAAAGTTTCTTCACATTCT | 37 |
| Bovine Growth Hormone 5' UTR | CAGGGTCCTGTGGACAGCTCACCAGCT | 38 |
| Bovine Growth Hormone 3' UTR | TTGCCAGCCATCTGTTGTTTGCCCCTCCCCCGTGCCTTCCTTGACCCTGGAAGGTGCCACTCCCACTGTCCTTTCCTAATAAAATGAGGAAATTGCATCGCA | 39 |
| *Mus musculus* hemoglobin alpha, adult chain 1 (Hba-a1), 3' UTR | GCTGCCTTCTGCGGGGCTTGCCTTCTGGCCATGCCCTTCTTCTCTCCCTTGCACCTGTACCTCTTGGTCTTTGAATAAAGCCTGAGTAGGAAG | 40 |
| HSD17B4 5' UTR | TCCCGCAGTCGGCGTCCAGCGGCTCTGCTTGTTCGTGTGTGTGTCGTTGCAGGCCTTATTC | 41 |
| G282 guide RNA targeting TTR | mU*mU*mA*CAGCCACGUCUACAGCAGUUUUAGAmGmCmUmAmGmAmAmUmAmGmCAAGUUAAAAUAAGGCUAGUCCGUUAUCAmAmCmUmUmGmAmAmAmAmGmUmGmGmCmAmCmCmGmAmGmUmCmGmGmUmGmCmU*mU*mU*mU | 42 |
| Cas9 transcript with 5' | GGGTCCCGCAGTCGGCGTCCAGCGGCTCTGCTTGTTCGTGTGTGTCGTTGCAGGCCTTATTCGGATCCGCCACCATGGACAAGAAGTACAGCATCGGACTGGACATCGGAACAAACAGCGTCGGATGGGCAGTCATCACAGACGAATACAAGGTCCCGAGCAAGAAGTTCAAGGTCCTGGGAAACACAGACAGACACAGCATCAAGAAGAACCTGATCGGAGCACTGCTGTTCGACAGCGGAGAAACAGCAGAAGCAACAAGACTGAAGAGAACAGCAAGAAGAAGATACACAAGAAGAAAGAACAGAATCTGCTACCTGCAGGAAATCTTCAGCAACGAAATGGCAAAGGTCGACGACAGCTTCTTCCACAGACTGGAAGAAAGCTTCCTGGTCGAAGAAGACAAGAAGCACGAAAGACACCCGATCTTCGGAAACATCGTCGACGAAGTCGCATACCACGA | 43 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| UTR of HSD, ORF corresponding to SEQ ID NO: 4, Kozak sequence, and 3' UTR of ALB | AAAGTACCCGACAATCTACCACCTGAGAAAGAAGCTGGTCGACAGCACAGACAAGGCA-GACCTGAGACTGATCTACCTGGCACTGGCACACAT<br>GATCAAGTTCAGAGGACACTTCCTGATCGAAGGAGACCT-GAACCCGGACAACAGCGACGTCGACAAGCTGTTCATCCAGCTGGTCCAGACATA<br>CAACCAGCTGTTCGAAGAAAACCCGATCAACGCAAGCGGAGTCGACGCAAAGGCAATCCT-GAGCGCAAGACTGAGCAAGAGCAGAAGACTGGA<br>AAACCTGATCGCACAGCTGCCGGGAGAAAAGAAGAACGGACTGTTCGGAAACCT-GATCGCACTGAGCCTGGGACTGACACCGAACTTCAAGAG<br>CAACTTCGACCTGGCAGAAGACGCAAAGCTGCAGCTGAGCAAGGACACAT-ACGACGACGACCTGGACAACCTGCTGGCACAGATCGGAGACCA<br>GTACGCAGACCTGTTCCTGGCAGCAAAGAACCTGAGCGACGCAATCCTGCTGAGCGA-CATCCTGAGAGTCAACACAGAAATCACAAAGGCACC<br>GCTGAGCGCAAGCATGATCAAGAGATACGACGAACACCACCAGGACCTGACACTGCT-GAAGGCACTGGTCAGACAGCAGCTGCCGGAAAAGTA<br>CAAGGAAATCTTCTTCGACCAGAGCAAGAACGGATACGCAGGATACATCGACGGAG-GAGCAAGCCAGGAAGAATTCTACAAGTTCATCAAGCC<br>GATCCTGGAAAAGATGACGGAACAGAAGAACTGCTGGTCAAGCTGAACAGAGAA-GACCTGCTGAGAAAGCAGAGAACATTCGACAACGGAAG<br>CATCCCGCACCAGATCCACCTGGGAGAACTGCACGCAATCCTGAGAAGACAGGAA-GACTTCTACCCGTTCCTGAAGGACAACAGAGAAAAGAT<br>CGAAAAGATCCTGACATTCAGAATCCCGTACTACGTCGGACCGCTGGCAAGAG-GAAACAGCAGATTCGCATGGATGACAAGAAAGAGCGAAGA<br>AACAATCACACCGTGGAACTTCGAAGAAGTCGTCGACAAGGGAGCAAGCGCACAGAGCTT-CATCGAAAGAATGACAAACTTCGACAAGAACCT<br>GCCGAACGAAAAGGTCCTGCCGAAGCACAGCCTGCTGTACGAATACTTCACAGTCTA-CAACGAACTGACAAAGGTCAAGTACGTCACAGAAGG<br>AATGAGAAAGCCGGCATTCCTGAGCGGAGAACAGAAGAAGGCAATCGTCGACCTGCTGTT-CAAGACAAACAGAAAGGTCACAGTCAAGCAGCT<br>GAAGGAAGACTACTTCAAGAAGATCGAATGCTTCGACAGCGTCGAAATCAGCG-GAGTCGAAGACAGATTCAACGCAAGCCTGGGAACATACCA<br>CGACCTGCTGAAGATCATCAAGGACAAGGACTTCCTGGACAACGAAGAAAACGAAGA-CATCCTGGAAGACATCGTCCTGACACTGACACTGTT<br>CGAAGACAGAGAAATGATCGAAGAAAGACTGAAGACAT-ACGCACACCTGTTCGACGACAAGGTCATGAAGCAGCTGAAGAGAAGAAGATACAC<br>AGGATGGGGAAGACTGAGCAGAAAGCTGATCAACGGAATCAGAGACAAGCAGAGCGGAAA-GACAATCCTGGACTTCCTGAAGAGCGACGGATT<br>CGCAAACAGAAACTTCATGCAGCTGATCCACGACGACAGCCTGACATTCAAGGAAGA-CATCCAGAAGGCACAGGTCAGCGGACAGGGAGACAG<br>CCTGCACGAACACATCGCAAACCTGGCAGGAAGCCCGGCAATCAAGAAGGGAATCCTGCA-GACAGTCAAGGTCGTCGACGAACTGGTCAAGGT<br>CATGGGAAGACACAAGCCGGAAAACATCGTCATCGAAATGGCAAGAGAAAACCA-GACAACACAGAGGGACAGAAGAACAGCAGAGAAAGAAT<br>GAAGAGAATCGAAGAAGGAATCAAGGAACTGGGAAGCCAGATCCT-GAAGGACACCCGGTCGAAAACACACAGCTGCAGAACGAAAAGCTGTA<br>CCTGTACTACCTGCAGAACGGAAGAGACATGTACGTCGACCAGGAACTGGACATCAACA-GACTGAGCGACTACGACGTCGACCACATCGTCCC<br>GCAGAGCTTCCTGAAGGACGACAG-CATCGACAACAAGGTCCTGACAAGAAGCGACAAGAACAGAGGAAAGAGCGACAACGTCCCGAGCGAAGA<br>AGTCGTCAAGAAGATGAAGAACTACTGGAGACAGCTGCTGAACGCAAAGCTGAT-CACACAGAGAAAGTTCGACAACCTGACAAAGGCAGAGAG<br>AGGAGGACTGAGCGAACTGGACAAGGCAGGATTCATCAAGAGACAGCTGGTCGAAACAA-GACAGATCACAAAGCACGTCGCACAGATCCTGGA<br>CAGCAGAATGAACACAAAGTACGACGAAAACGACAAGCTGATCAGAGAAGTCAAGGTCAT-CACACTGAAGAGCAAGCTGGTCAGCGACTTCAG<br>AAAGGACTTCCAGTTCTACAAGGTCAGAGAAATCAACAACTACCACCACGCACACGACG-CATACCTGAACGCAGTCGTCGGAACAGCACTGAT<br>CAAGAAGTACCCGAAGCTGGAAAGCGAATTCGTCTACGGAGACTACAAGGTC-TACGACGTCAGAAAGATGATCGCAAAGAGCGAACAGGAAAT<br>CGGAAAGGCAACAGCAAAGTACTTCTTCTACAGCAACATCATGAACTTCTTCAA-GACAGAAATCACACTGGCAAACGGAGAAATCAGAAAGAG<br>ACCGCTGATCGAAACAAACGGAGAAACAGGAGAAATCGTCTGGGACAAGGGAAGA-GACTTCGCAACAGTCAGAAAGGTCCTGAGCATGCCGCA<br>GGTCAACATCGTCAAGAAGACAGAAGTCCAGACAGGAGGAT-TCAGCAAGGAAAGCATCCTGCCGAAGAGAAACAGCGACAAGCTGATCGCAAG<br>AAAGAAGGACTGGGACCCGAAGAAGTACGGAGGATTCGACAGCCCGACAGTCGCATA-CAGCGTCCTGGTCGTCGCAAAGGTCGAAAAGGGAAA<br>GAGCAAGAAGCTGAAGAGCGTCAAGGAACTGCTGGGAATCACAATCATG-GAAAGAAGCAGCTTCGAAAAGAACCCGATCGACTTCCTGGAAGC<br>AAAGGGATACAAGGAAGTCAAGAAGGACCTGATCATCAAGCTGCCGAAGTA-CAGCCTGTTCGAACTGGAAAACGGAAGAAAGAGAATGCTGGC<br>AAGCGCAGGAGAACTGCAGAAGGGAAACGAACTGGCACTGCCGAGCAAGTACGT-CAACTTCCTGTACCTGGCAAGCCACTACGAAAAGCTGAA<br>GGGAAGCCCGGAAGACAACGAACAGAAGCAGCTGTTCGTCGAACAGCACAAGCAC-TACCTGGACGAAATCATCGAACAGATCAGCGAATTCAG<br>CAAGAGAGTCATCCTGGCAGACGCAAACCTGGACAAGGTCCTGAGCGCATA-CAACAAGCACAGAGACAAGCCGATCAGAGAACAGGCAGAAAA | |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | CATCATCCACCTGTTCACACTGACAAACCTGGGAGCACCGGCAGCATT-CAAGTACTTCGACACAACAATCGACAGAAAGAGATACACAAGCACAAAGGAAGTCCTGGACGCAACACTGATCCACCAGAGCAT-CACAGGACTGTACGAAACAAGAATCGACCTGAGCCAGCTGGGAGGAGACGGAGGAGGAAGCCCGAAGAAGAAGAGAAAGGTCTAGCTAGCCATCACATT-TAAAAGCATCTCAGCCTACCATGAGAATAAGAGAAAGAAAATGAAGATCAATAGCTTATTCATCTCTTTTTCTTTTTCGTTGGTGTAAAGC-CAACACCCTGTCTAAAAAACATAAATTTCTTTAATCATTTTGCCTCTTTTCTCTGTGCTTCAATTAATAAAAAATGGAAAGAACCTCGAG | |
| Cas9 transcript with 5' UTR of HSD, ORF corresponding to SEQ ID NO: 4, and 3' UTR of ALB | GGGTCCCGCAGTCGGCGTCCAGCGGCTCTGCTTGTTCGTGTGTGTCGTTGCAGGCCTT-ATTCGGATCCATGGACAAGAAGTACAGCATCGGACTGGACATCGGAACAAACAGCGTCGGATGGGCAGTCATCACAGACGAATA-CAAGGTCCCGAGCAAGAAGTTCAAGGTCCTGGGAAACACAGACAGACACAGCATCAAGAAGAACCTGATCGGAGCACTGCTGTTCGACAGCG-GAGAAACAGCAGAAGCAACAAGACTGAAGAGAACAGCAAGAAGAAGATACACAAGAAGAAAGAACAGAATCTGCTACCTGCAG-GAAATCTTCAGCAACGAAATGGCAAAGGTCGACGACAGCTTCTTCCACAGACTGGAAGAAAGCTTCCTGGTCGAAGAAGACAAGAAGCACGAAAGACACCCGATCTTCGGAAA-CATCGTCGACGAAGTCGCATACCACGAAAGTACCCGACAATCTACCACCTGAGAAAGAAGCTGGTCGACAGCACAGACAAGGCAGACCTGA-GACTGATCTACCTGGCACTGGCACACATGATCAAGTTCAGAGGACACTTCCTGATCGAAGGAGACCT-GAACCCGGACAACAGCGACGTCGACAAGCTGTTCATCCAGCTGGTCCAGACATACAACCAGCTGTTCGAAGAAAACCCGATCAACGCAAGCGGAGTCGACGCAAAGGCAATCCT-GAGCGCAAGACTGAGCAAGAGCAGAAGACTGGAAAAACCTGATCGCACAGCTGCCGGGAGAAAAGAAGAACGGACTGTTCGGAAACCTGATCGCACT-GAGCCTGGGACTGACACCGAACTTCAAGAGCAACTTCGACCTGGCAGAAGACGCAAAGCTGCAGCTGAGCAAGGACACAT-ACGACGACGACCTGGACAACCTGCTGGCACAGATCGGAGACCAGTACGCAGACCTGTTCCTGGCAGCAAAGAACCTGAGCGACGCAATCCTGCTGAGCGACATCCT-GAGAGTCAACACAGAAATCACAAAGGCACCGCTGAGCGCAAGCATGATCAAGAGATACGACGAACACCACCAGGACCTGACACTGCT-GAAGGCACTGGTCAGACAGCAGCTGCCGGAAAAGTACAAGGAAATCTTCTTCGACCAGAGCAAGAACGGATACGCAGGATACATCGACGGAG-GAGCAAGCCAGGAAGAATTCTACAAGTTCATCAAGCCGATCCTGGAAAAGATGGACGGAACAGAAGAACTGCTGGTCAAGCTGAACAGAGAAGACCTGCT-GAGAAAGCAGAGAACATTCGACAACGGAAGCATCCCGCACCAGATCCACCTGGGAGAACTGCACGCAATCCTGAGAAGACAGGAAGACTTC-TACCCGTTCCTGAAGGACAACAGAGAAAAGATCGAAAAGATCCTGACATTCAGAATCCCGTACTACGTCGGACCGCTGGCAAGAGGAAACAGCAGAT-TCGCATGGATGACAAGAAAGAGCGAAGAAACAATCACACCGTGGAACTTCGAAGAAGTCGTCGACAAGGGAGCAAGCGCACAGAGCTT-CATCGAAAGAATGACAAACTTCGACAAGAACCTGCCGAACGAAAAGGTCCTGCCGAAGCACAGCCTGCTGTACGAATACTTCACAGTCTA-CAACGAACTGACAAAGGTCAAGTACGTCACAGAAGGAATGAGAAAGCCGGCATTCCTGAGCGGAGAACAGAAGAAGGCAATCGTCGACCTGCTGTTCAA-GACAAACAGAAAGGTCACAGTCAAGCAGCTGAAGGAAGACTACTTCAAGAAGATCGAATGCTTCGACAGCGTCGAAATCAGCGGAGTCGAAGACA-GATTCAACGCAAGCCTGGGAACATACCACGACCTGCTGAAGATCATCAAGGACAAGGACTTCCTGGACAACGAAGAAAACGAAGACATCCTG-GAAGACATCGTCCTGACACTGACACTGTTCGAAGACAGAGAAATGATCGAAGAAAGACTGAAGACATACGCACACCTGTTCGACGACAAGGTCATGAAGCAGCTGAAGAGAAGAAGATACACAGGATGGGGAAGACTGAGCAGAAAGCTGATCAACGGAATCAGAGACAAGCAGAGCGGAAA-GACAATCCTGGACTTCCTGAAGAGCGACGGATTCGCAAACAGAAACTTCATGCAGCTGATCCACGACGACAGCCTGACATTCAAGGAAGA-CATCCAGAAGGCACAGGTCAGCGGACAGGGAGACAGCCTGCACGAACACATCGCAAACCTGGCAGGAAGCCCGGCAATCAAGAAGGGAATCCTGCAGACAGT-CAAGGTCGTCGACGAACTGGTCAAGGTCATGGGAAGACACAAGCCGGAAAACATCGTCATCGAAATGGCAAGAGAAAACCA-GACAACACAGAAGGGACAGAAGAACAGCAGAGAAAGAATGAAGAGAATCGAAGAAGGAATCAAGGAACTGGGAAGCCAGATCCT-GAAGGAACACCCGGTCGAAAACACACAGCTGCAGAACGAAAAGCTGTACCTGTACTACCTGCAGAACGGAAGAGACATGTACGTCGACCAGGAACTGGACATCAACAGACT-GAGCGACTACGACGTCGACCACATCGTCCCGCAGAGCTTCCTGAAGGACGACAGCATCGACAACAAGGTCCTGACAAGAAGCGACAAGAACAGAG-GAAAGAGCGACAACGTCCCGAGCGAAGAAGTCGTCAAGAAGATGAAGAACTACTGGAGACAGCTGCTGAACGCAAAGCTGAT-CACACAGAGAAAGTTCGACAACCTGACAAAGGCAGAGAGAGGAGGACTGAGCGAACTGGACAAGGCAGGATTCATCAAGAGACAGCTGGTCGAAACAAGACAGAT-CACAAAGCACGTCGCACAGATCCTGGACAGCAGAATGAACACAAAGTACGACGAAAACGACAAGCTGATCAGAGAAGTCAAGGTCATCACACT-GAAGAGCAAGCTGGTCAGCGACTTCAGAAAGGACTTCCAGTTCTACAAGGTCAGAGAAATCAACAACTACCACCACGCACACGACGCATACCT-GAACGCAGTCGTCGGAACAGCACTGATCAAGAA | 44 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | GTACCCGAAGCTGGAAAGCGAATTCGTCTACGGAGACTACAAGGTCTACGACGTCAGAAA-GATGATCGCAAAGAGCGAACAGGAAATCGGAAA GGCAACAGCAAAGTACTTCTTCTACAGCAACATCATGAACTTCTTCAAGACAGAAAT-CACACTGGCAAACGGAGAAATCAGAAAGAGACCGCT GATCGAAACAAACGGAGAAACAGGAGAAATCGTCTGGGACAAGGGAAGA-GACTTCGCAACAGTCAGAAAGGTCCTGAGCATGCCGCAGGTCAA CATCGTCAAGAAGACAGAAGTCCAGACAGGAGGAT-TCAGCAAGGAAAGCATCCTGCCGAAGAGAAACAGCGACAAGCTGATCGCAAGAAAGAA GGACTGGGACCCGAAGAAGTACGGAGGATTCGACAGCCCGACAGTCGCATA-CAGCGTCCTGGTCGTCGCAAAGGTCGAAAAGGGAAAGAGCAA GAAGCTGAAGAGCGTCAAGGAACTGCTGGGAATCACAATCATG-GAAAGAAGCAGCTTCGAAAAGAACCCGATCGACTTCCTGGAAGCAAAGGG ATACAAGGAAGTCAAGAAGGACCTGATCATCAAGCTGCCGAAGTA-CAGCCTGTTCGAACTGGAAAACGGAAGAAAGAGAATGCTGGCAAGCGC AGGAGAACTGCAGAAGGGAAACGAACTGGCACTGCCGAGCAAGTACGT-CAACTTCCTGTACCTGGCAAGCCACTACGAAAAGCTGAAGGGAAG CCCGGAAGACAACGAACAGAAGCAGCTGTTCGTCGAACAGCACAAGCAC-TACCTGGACGAAATCATCGAACAGATCAGCGAATTCAGCAAGAG AGTCATCCTGGCAGACGCAAACCTGGACAAGGTCCTGAGCGCATACAACAAGCACAGA-GACAAGCCGATCAGAGAACAGGCAGAAAACATCAT CCACCTGTTCACACTGACAAACCTGGGAGCACCGGCAGCATT-CAAGTACTTCGACACAACAATCGACAGAAAGAGATACACAAGCACAAAGGA AGTCCTGGACGCAACACTGATCCACCAGAGCAT-CACAGGACTGTACGAAACAAGAATCGACCTGAGCCAGCTGGGAGGAGACGGAGGAGGAAG CCCGAAGAAGAAGAGAAAGGTCTAGCTAGCCATCACATTTAAAAGCATCTCAGCCTAC-CATGAGAATAAGAGAAAGAAAATGAAGATCAATAG CTTATTCATCTCTTTTTCTTTTTCGTTGGTGTAAAGCCAACACCCTGTCTAAAAAACAT-AAATTTCTTTAATCATTTTGCCTCTTTTCTCTGT GCTTCAATTAATAAAAAATGGAAAGAACCTCGAG | |
| Alternative Cas9 ORF with 19.36% U content | ATGGATAAGAAGTACTCGATCGGGCTGGATATCGGAACTAATTCCGTGGGTTGGGCAGT-GATCACGGATGAATACAAAGTGCCGTCCAAGAAG TTCAAGGTCCTGGGGAACACCGATAGACACAGCATCAAGAAGAATCTCATCG-GAGCCCTGCTGTTTGACTCCGGCGAAACCGCAGAAGCGACC CGGCTCAAACGTACCGCGAGGCGACGCTACACCCGGCGGAAGAATCGCATCTGC-TATCTGCAAGAAATCTTTTCGAACGAAATGGCAAAGGTG GACACAGCTTCTTCCACCGCCTGGAAGAATCTTTCCTGGTGGAGGAGGACAAGAAGCAT-GAACGGCATCCTATCTTTGGAAACATCGTGGAC GAAGTGCGTACCACGAAAGTACCCGACCATCTACCATCTGCG-GAAGAAGTTGGTTGACTCAACTGACAAGGCCGACCTCAGATTGATCTAC TTGGCCCTCGCCCATATGATCAAATTCCGCGGACACTTCCTGATCGAAGGCGATCT-GAACCCTGATAACTCCGACGTGGATAAGCTGTTCATT CAACTGGTGCAGACCTACAACCAACTGTTCGAAGAAAACCCAATCAATGCCAGCGGCGTC-GATGCCAAGGCCATCCTGTCCGCCCGGCTGTCG AAGTCGCGGCGCCTCGAAAACCTGATCGCACAGCTGCCGG-GAGAGAAGAAGAACGGACTTTTCGGCAACTTGATCGCTCTCTCACTGGGACTC ACTCCCAATTTCAAGTCCAATTTTGACCTGGCCGAGGACGCGAAGCTGCAACTCT-CAAAGGACACCTACGACGACTTGGACAATTTGCTG GCACAAATTGGCGATCAGTACGCG-GATCTGTTCCTTGCCGCTAAGAACCTTTCGGACGCAATCTTGCTGTCCGATATCCTGCGCGTGAACACC GAAATAACCAAAGCGCCGCTTAGCGCCTCGATGATTAAGCGGTACGACGAGCATCACCAG-GATCTCACGCTGCTCAAAGCGCTCGTGAGACAG CAACTGCCTGAAAAGTACAAGGAGATTTTCTTCGACCAGTC-CAAGAATGGGTACGCAGGGTACATCGATGGAGGCGCCAGCCAGGAAGAGTTC TATAAGTTCATCAAGCCAATCCTGGAAAAGATGGACGGAACCGAAGAACTGCTGGT-CAAGCTGAACAGGGAGGATCTGCTCCGCAAACAGAGA ACCTTTGACAACGGAAGCATTCCACACCAGATCCATCTGGGTGAGCTGCACGC-CATCTTGCGGCGCCAGGAGGACTTTTACCCATTCCTCAAG GACAACCGGGAAAAGATCGAGAAAATTCTGACGTTCCGCATCCCGTATTACGTGGGCC-CACTGGCGCGCGGCAATTCGCGCTTCGCGTGGATG ACTAGAAAATCAGAGGAAACCATCACTCCTTGGAATTTCGAGGAAGTTGTGGATAAGG-GAGCTTCGGCACAATCCTTCATCGAACGAATGACC AACTTCGACAAGAATCTCCCAAACGAGAAGGTGCTTCCTAAGCACAGCCTCCTT-TACGAATACTTCACTGTCTACAACGAACTGACTAAAGTG AAATACGTTACTGAAGGAATGAGGAAGCCGGCCTTTCTGAGCGGAGAACAGAAGAAAGC-GATTGTCGATCTGCTGTTCAAGACCAACCGCAAG GTGACCGTCAAGCAGCTTAAAGAGGACTACTTCAAGAAGATCGAGTGTTTCGACTCAGTG-GAAATCAGCGGAGTGGAGGACAGATTCAACGCT TCGCTGGGAACCTATCATGATCTCCTGAAGATCAT-CAAGGACAAGGACTTCTTGACAACGAGGAGAACGAGGACATCCTGGAAGATATCGTC CTGACCTTGACCCTTTTCGAGGATCGCGAGATGATCGAGGAGAGGCTTAAGACCTACGCT-CATCTCTTCGACGATAAGGTCATGAAACAACTC AAGCGCCGCCGGTACACTGGTTGGGGCCGCCTCTCCCGCAAGCTGATCAACGGTATTCGC-GATAAACAGAGCGGTAAAACTATCCTGGATTTC CTCAAATCGGATGGCTTCGCTAATCGTAACTTCATGCAGTTGATC-CACGACGACAGCCTGACCTTTAAGGAGGACATCCAGAAAGCACAAGTG | 45 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | AGCGGACAGGGAGACTCACTCCATGAACACATCGCGAATCTGGCCGGTTCGCCGGCGAT-TAAGAAGGGAATCCTGCAAACTGTGAAGGTGGTG GACGAGCTGGTGAAGGTCATGGGACGGCACAAACCGGAGAATATCGTGATT-GAAATGGCCCGAGAAAACCAGACTACCCAGAAGGGCCAGAAG AACTCCCGCGAAAGGATGAAGCGGATCGAAGAAGGAATCAAGGAGCTGGCAGCCA-GATCCTGAAAGAGCACCCGGTGGAAAACACGCAGCTG CAGAACGAGAAGCTCTACCTGTACTATTTGCAAAATGGACGGGACATGTACGTGGAC-CAAGAGCTGGACATCAATCGGTTGTCTGATTACGAC GTGGACCACATCGTTCCACAGTCCTTTCTGAAGGATGACTCCATCGA-TAACAAGGTGTTGACTCGCAGCGACAAGAACAGAGGGAAGTCAGAT AATGTGCCATCGGAGGAGGTCGTGAAGAAGATGAAGAATTACTGGCGGCAGCTCCT-GAATGCGAAGCTGATTACCCAGAGAAAGTTTGACAAT CTCACTAAAGCCGAGCGCGGCGGACTCTCAGAGCTGGATAAGGCTGGATTCAT-CAAACGGCAGCTGGTCGAGACTCGGCAGATTACCAAGCAC GTGGCGCAGATCCTGGACTCCCGCATGAACACTAAATACGACGAGAACGATAAGCT-CATCCGGGAAGTGAAGGTGATTACCCTGAAAAGCAAA CTTGTGTCGGACTTTCGGAAGGACTTTCAGTTTTACAAAGTGAGAGAAATCAACAACTAC-CATCACGCGCATGACGCATACCTCAACGCTGTG GTCGGCACCGCCCTGATCAAGAAGTACCCTAAACTTGAATCGGAGTTTGTGTACGGAGAC-TACAAGGTCTACGACGTGAGGAAGATGATAGCC AAGTCCGAACAGGAAATCGGGAAAGCAACTGCGAAATACTTCTTTTACTCAAACATCAT-GAACTTCTTCAAGACTGAAATTACGCTGGCCAAT GGAGAAATCAGGAAGAGGCCACTGATCGAAACTAACG-GAGAAACGGGCGAAATCGTGTGGGACAAGGGCAGGGACTTCGCAACTGTTCGCAAA GTGCTCTCTATGCCGCAAGTCAATATTGTGAAGAAAACCGAAGTGCAAACCGGCGGAT-TTTCAAAGGAATCGATCCTCCCAAAGAGAAATAGC GACAAGCTCATTGCACGCAAGAAAGACTGGGACCCGAAGAAGTACGGAGGATTCGAT-TCGCCGACTGTCGCATACTCCGTCCTCGTGGTGGCC AAGGTGGAGAAGGGAAAGAGCAAGAAGCTCAAATCCGTCAAAGAGCTGCTGGGGATTAC-CATCATGGAACGATCCTCGTTCGAGAAGAACCCG ATTGATTTCCTGGAGGCGAAGGGTTACAAGGAGGTGAAGAAGGATCTGATCAT-CAAACTGCCCAAGTACTCACTGTTCGAACTGGAAAATGGT CGGAAGCGCATGCTGGCTTCGGCCGGAGAACTCCAGAAAGGAAAT-GAGCTGGCCTTGCCTAGCAAGTACGTCAACTTCCTCTATCTTGCTTCG CACTACGAGAAACTCAAAGGGTCACCGGAAGATAACGAACAGAAGCAGCTTTTCGTG-GAGCAGCACAAGCATTATCTGGATGAAATCATCGAA CAAATCTCCGAGTTTTCAAAGCGCGTGATCCTCGCCGACGC-CAACCTCGACAAAGTCCTGTCGGCCTACAATAAGCATAGAGATAAGCCGATC AGAGAACAGGCCGAGAACATTATCCACTTGTTCACCCTGACTAACCTGG-GAGCTCCAGCCGCCTTCAAGTACTTCGATACTACTATCGACCGC AAAAGATACACGTCCACCAAGGAAGTTCTGGACGCGACCCTGATCCACCAAAGCAT-CACTGGACTCTACGAAACTAGGATCGATCTGTCGCAG CTGGGTGGCGATGGTGGCGGTGGATCCTACCCATACGACGTGCCTGACTACGCCTCCG-GAGGTGGTGGCCCCAAGAAGAAACGGAAGGTGTGA TAG | |
| Cas9 transcript with 5' UTR of HSD, ORF corresponding to SEQ ID NO: 45, Kozak se- | GGGTCCCGCAGTCGGCGTCCAGCGGCTCTGCTTGTTCGTGTGTGTCGTTGCAGGCCTT-ATTCGGATCTGCCACCATGGATAAGAAGTACTC GATCGGGCTGGATATCGGAACTAATTCCGTGGGTTGGGCAGTGATCACGGATGAATA-CAAAGTGCCGTCCAAGAAGTTCAAGGTCCTGGGGAA CACCGATAGACACAGCATCAAGAAGAATCTCATCG-GAGCCCTGCTGTTTGACTCCGGCGAAACCGCAGAAGCGACCCGGCTCAAACGTACCGC GAGGCGACGCTACACCCGGCGGAAGAATCGCATCTGC-TATCTGCAAGAAATCTTTTCGAACGAAATGGCAAAGGTGGACGACAGCTTCTTCCA CCGCCTGGAAGAATCTTTCCTGGTGGAGGAGGACAAGAAGCATGAACGGCATCC-TATCTTTGGAAACATCGTGGACGAAGTGGCGTACCACGA AAAGTACCCGACCATCTACCATCTGCGGAAGAAGTTGGTTGACT-CAACTGACAAGGCCGACCTCAGATTGATCTACTTGGCCCTCGCCCATAT GATCAAATTCCGCGGACACTTCCTGATCGAAGGCGATCTGAACCCTGA-TAACTCCGACGTGGATAAGCTGTTCATTCAACTGGTGCAGACCTA CAACCAACTGTTCGAAGAAAACCCAATCAATGCCAGCGGCGTCGATGCCAAGGC-CATCCTGTCCGCCCGGCTGTCGAAGTCGCGGCGCCTCGA AAACCTGATCGCACAGCTGCCGGGAGAGAAGAAGAACGGACTTTTCGGCAACTT-GATCGCTCTCTCACTGGGACTCACTCCCAATTTCAAGTC CAATTTTGACCTGGCCGAGGACGCGAAGCTGCAACTCTCAAAGGACACC-TACGACGACGACTTGGACAATTTGCTGGCACAAATTGGCGATCA GTACGCGGATCTGTTCCTTGCCGCTAAGAACCTTTCGGACGCAATCTTGCTGTCCGA-TATCCTGCGCGTGAACACCGAAATAACCAAAGCGCC GCTTAGCGCCTCGATGATTAAGCGGTACGACGAGCATCACCAGGATCTCACGCTGCT-CAAAGCGCTCGTGAGACAGCAACTGCCTGAAAAGTA CAAGGAGATTTTCTTCGACCAGTCCAAGAATGGGTACGCAGGGTACATCGATG-GAGGCGCCAGCCAGGAAGAGTTCTATAAGTTCATCAAGCC AATCCTGGAAAAGATGGACGGAACCGAAGAACTGCTGGTCAAGCTGAACAGGGAG-GATCTGCTCCGCAAACAGAGAACCTTTGACAACGGAAG CATTCCACACCAGATCCATCTGGGTGAGCTGCACGCCATCTTGCGGCGCCAG-GAGGACTTTTACCCATTCCTCAAGGACAACCGGGAAAAGAT | 46 |

-continued

Sequence Table
The following sequence table provides a listing of sequences disclosed herein. It is understood that if a DNA sequence (comprising Ts) is referenced with respect to an RNA, then Ts should be replaced with Us(which may be modified or unmodified depending on the context), and vice versa.

| Description | Sequence | SEQ ID No. |
|---|---|---|
| quence, and 3' UTR of ALB | CGAGAAAATTCTGACGTTCCGCATCCCGTATTACGTGGGCCCACTGGCGCGCGGCAATTCGCGCTTCGCGTGGATGACTAGAAAATCAGAGGA AACCATCACTCCTTGGAATTTCGAGGAAGTTGTGGATAAGGGAGCTTCGGCACAATCCTTCATCGAACGAATGACCAACTTCGACAAGAATCT CCCAAACGAGAAGGTGCTTCCTAAGCACAGCCTCCTTTACGAATACTTCACTGTCTACAACGAACTGACTAAAGTGAAATACGTTACTGAAGG AATGAGGAAGCCGGCCTTTCTGAGCGGAGAACAGAAGAAAGCGATTGTCGATCTGCTGTTCAAGACCAACCGCAAGGTGACCGTCAAGCAGCT TAAAGAGGACTACTTCAAGAAGATCGAGTGTTTCGACTCAGTGGAAATCAGCGGAGTGGAGGACAGATTCAACGCTTCGCTGGGAACCTATCA TGATCTCCTGAAGATCATCAAGGACAAGGACTTCCTTGACAACGAGGAGAACGAGGACATCCTGGAAGATATCGTCCTGACCTTGACCCTTTT CGAGGATCGCGAGATGATCGAGGAGAGGCTTAAGACCTACGCTCATCTCTTCGACGATAAGGTCATGAAACAACTCAAGCGCCGCCGGTACAC TGGTTGGGGCCGCCTCTCCCGCAAGCTGATCAACGGTATTCGCGATAAACAGAGCGGTAAAACTATCCTGGATTTCCTCAAATCGGATGGCTT CGCTAATCGTAACTTCATGCAGTTGATCCACGACGACAGCCTGACCTTTAAGGAGGACATCCAGAAAGCACAAGTGAGCGGACAGGGAGACTC ACTCCATGAACACATCGCGAATCTGGCCGGTTCGCCGGCGATTAAGAAGGGAATCCTGCAAACTGTGAAGGTGGTGGACGAGCTGGTGAAGGT CATGGGACGGCACAAACCGGAGAATATCGTGATTGAAATGGCCCGAGAAAACCAGACTACCCAGAAGGGCCAGAAGAACTCCCGCGAAAGGAT GAAGCGGATCGAAGAAGGAATCAAGGAGCTGGGCAGCCAGATCCTGAAAGAGCACCCGGTGGAAAACACGCAGCTGCAGAACGAGAAGCTCTA CCTGTACTATTTGCAAAATGGACGGGACATGTACGTGGACCAAGAGCTGGACATCAATCGGTTGTCTGATTACGACGTGGACCACATCGTTCC ACAGTCCTTTCTGAAGGATGACTCCATCGATAACAAGGTGTTGACTCGCAGCGACAAGAACAGAGGGAAGTCAGATAATGTGCCATCGGAGGA GGTCGTGAAGAAGATGAAGAATTACTGGCGGCAGCTCCTGAATGCGAAGCTGATTACCCAGAGAAAGTTTGACAATCTCACTAAAGCCGAGCG CGGCGGACTCTCAGAGCTGGATAAGGCTGGATTCATCAAACGGCAGCTGGTCGAGACTCGGCAGATTACCAAGCACGTGGCGCAGATCCTGGA CTCCCGCATGAACACTAAATACGACGAGAACGATAAGCTCATCCGGGAAGTGAAGGTGATTACCCTGAAAAGCAAACTTGTGTCGGACTTTCG GAAGGACTTTCAGTTTTACAAAGTGAGAGAAATCAACAACTACCATCACGCGCATGACGCATACCTCAACGCTGTGGTCGGCACCGCCCTGAT CAAGAAGTACCCTAAACTTGAATCGGAGTTTGTGTACGGAGACTACAAGGTCTACGACGTGAGGAAGATGATAGCCAAGTCCGAACAGGAAAT CGGGAAAGCAACTGCGAAATACTTCTTTTACTCAAACATCATGAACTTCTTCAAGACTGAAATTACGCTGGCCAATGGAGAAATCAGGAAGAG GCCACTGATCGAAACTAACGGAGAAACGGGCGAAATCGTGTGGGACAAGGGCAGGGACTTCGCAACTGTTCGCAAAGTGCTCTCTATGCCGCA AGTCAATATTGTGAAGAAAACCGAAGTGCAAACCGGCGGATTTTCAAAGGAATCGATCCTCCCAAAGAGAAATAGCGACAAGCTCATTGCACG CAAGAAAGACTGGGACCCGAAGAAGTACGGAGGATTCGATTCGCCGACTGTCGCATACTCCGTCCTCGTGGTGGCCAAGGTGGAGAAGGGAAA GAGCAAGAAGCTCAAATCCGTCAAAGAGCTGCTGGGGATTACCATCATGGAACGATCCTCGTTCGAGAAGAACCCGATTGATTTCCTGGAGGC GAAGGGTTACAAGGAGGTGAAGAAGGATCTGATCATCAAACTGCCCAAGTACTCACTGTTCGAACTGGAAAATGGTCGGAAGCGCATGCTGGC TTCGGCCGGAGAACTCCAGAAAGGAAATGAGCTGGCCTTGCCTAGCAAGTACGTCAACTTCCTCTATCTTGCTTCGCACTACGAGAAACTCAA AGGGTCACCGGAAGATAACGAACAGAAGCAGCTTTTCGTGGAGCAGCACAAGCATTATCTGGATGAAATCATCGAACAAATCTCCGAGTTTTC AAAGCGCGTGATCCTCGCCGACGCCAACCTCGACAAAGTCCTGTCGGCCTACAATAAGCATAGAGATAAGCCGATCAGAGAACAGGCCGAGAA CATTATCCACTTGTTCACCCTGACTAACCTGGGAGCTCCAGCCGCCTTCAAGTACTTCGATACTACTATCGACCGCAAAAGATACACGTCCAC CAAGGAAGTTCTGGACGCGACCCTGATCCACCAAAGCATCACTGGACTCTACGAAACTAGGATCGATCTGTCGCAGCTGGGTGGCGATGGTGG CGGTGGATCCTACCCATACGACGTGCCTGACTACGCCTCCGGAGGTGGTGGCCCCAAGAAGAAACGGAAGGTGTGATAGCTAGCCATCACATT TAAAAGCATCTCAGCCTACCATGAGAATAAGAGAAAGAAAATGAAGATCAATAGCTTATTCATCTCTTTTTCTTTTTCGTTGGTGTAAAGCCA ACACCCTGTCTAAAAAACATAAATTTCTTTAATCATTTTGCCTCTTTTCTCTGTGCTTCAATTAATAAAAAATGGAAAGAACCTCGAG | |
| Cas9 transcript with 5' | GGGTCCCGCAGTCGGCGTCCAGCGGCTCTGCTTGTTCGTGTGTGTCGTTGCAGGCCTTATTCGGATCTATGGATAAGAAGTACTCGATCGG GCTGGATATCGGAACTAATTCCGTGGGTTGGGCAGTGATCACGGATGAATACAAAGTGCCGTCCAAGAAGTTCAAGGTCCTGGGGAACACCGA TAGACACAGCATCAAGAAGAATCTCATCGGAGCCCTGCTGTTTGACTCCGGCGAAACCGCAGAAGCGACCCGGCTCAAACGTACCGCGAGGCG ACGCTACACCCGGCGGAAGAATCGCATCTGCTATCTGCAAGAAATCTTTTCGAACGAAATGGCAAAGGTGGACGACAGCTTCTTCCACCGCCT GGAAGAATCTTTCCTGGTGGAGGAGGACAAGAAGCATGAACGGCATCCTATCTTTGGAAACATCGTGGACGAAGTGGCGTACCACGAAAAGTA | 47 |

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| UTR of HSD, ORF corresponding to SEQ ID NO: 45, and 3' UTR of ALB | CCCGACCATCTACCATCTGCGGAAGAAGTTGGTTGACTCAACTGACAAGGCCGACCTCAGATTGATCTACTTGGCCCTCGCCCATATGATCAAATTCCGCGGACACTTCCTGATCGAAGGCGATCTGAACCCTGATAACTCCGACGTGGATAAGCTGTTCATTCAACTGGTGCAGACCTACAACCAACTGTTCGAAGAAAACCCAATCAATGCCAGCGGCGTCGATGCCAAGGCCATCCTGTCCGCCCGGCTGTCGAAGTCGCGGCGCCTCGAAAACCTGATCGCACAGCTGCCGGGAGAGAAGAAGAACGGACTTTTCGGCAACTTGATCGCTCTCTCACTGGGACTCACTCCCAATTTCAAGTCCAATTTTGACCTGGCCGAGGACGCGAAGCTGCAACTCTCAAAGGACACCTACGACGACGACTTGGACAATTTGCTGGCACAAATTGGCGATCAGTACGCGGATCTGTTCCTTGCCGCTAAGAACCTTTCGGACGCAATCTTGCTGTCCGATATCCTGCGCGTGAACACCGAAATAACCAAAGCGCCGCTTAGCGCCTCGATGATTAAGCGGTACGACGAGCATCACCAGGATCTCACGCTGCTCAAAGCGCTCGTGAGACAGCAACTGCCTGAAAAGTACAAGGAGATTTTCTTCGACCAGTCCAAGAATGGGTACGCAGGGTACATCGATGGAGGCGCCAGCCAGGAAGAGTTCTATAAGTTCATCAAGCCAATCCTGGGAAAAGATGGACGGAACCGAAGAACTGCTGGTCAAGCTGAACAGGGAGGATCTGCTCCGCAAACAGAGAACCTTTGACAACGGAAGCATTCCACACCAGATCCATCTGGGTGAGCTGCACGCCATCTTGCGGCGCCAGGAGGACTTTTACCCATTCCTCAAGGACAACCGGGAAAAGATCGAGAAAATTCTGACGTTCCGCATCCCGTATTACGTGGGCCCACTGGCGCGCGGCAATTCGCGCTTCGCGTGGATGACTAGAAAATCAGAGGAAACCATCACTCCTTGGAATTTCGAGGAAGTTGTGGATAAGGGAGCTTCGGCACAATCCTTCATCGAACGAATGACCAACTTCGACAAGAATCTCCCAAACGAGAAGGTGCTTCCTAAGCACAGCCTCCTTTACGAATACTTCACTGTCTACAACGAACTGACTAAAGTGAAATACGTTACTGAAGGAATGAGGAAGCCGGCCTTTCTGAGCGGAGAACAGAAGAAAGCGGATTGTCGATCTGCTGTTCAAGACCAACCGCAAGGTGACCGTCAAGCAGCTTAAAGAGGACTACTTCAAGAAGATCGAGTGTTTCGACTCAGTGGAAATCAGCGGAGTGGAGGACAGATTCAACGCTTCGCTGGGAACCTATCATGATCTCCTGAAGATCATCAAGGACAAGGACTTCCTTGACAACGAGGAGAACGAGGACATCCTGGAAGATATCGTCCTGACCTTGACCCTTTTCGAGGATCGCGAGATGATCGAGGAGAGGCTTAAGACCTACGCTCATCTCTTCGACGATAAGGTCATGAAACAACTCAAGCGCCGCCGGTACACTGGTTGGGGCCGCCTCTCCCGCAAGCTGATCAACGGTATTCGCGATAAACAGAGCGGTAAAACTATCCTGGATTTCCTCAAATCGGATGGCTTCGCTAATCGTAACTTCATGCAGTTGATCCACGACGACAGCCTGACCTTTAAGGAGGACATCCAGAAAGCACAAGTGAGCGGACAGGGAGACTCACTCCATGAACACATCGCGAATCTGGCCGGTTCGCCGGCGATTAAGAAGGGAATCCTGCAAACTGTGAAGGTGGTGGACGAGCTGGTGAAGGTCATGGGACGGCACACAAACCGGAGAATATCGTGATTGAAATGGCCCGAGAAAACCAGACTACCCAGAAGGGCCAGAAGAACTCCCGCGAAAGGATGAAGCGGATCGAAGAAGGAATCAAGGAGCTGGGCAGCCAGATCCTGAAAGAGCACCCGGTGGAAAACACGCAGCTGCAGAACGAGAAGCTCTACCTGTACTATTTGCAAAATGGACGGGACATGTACGTGGACCAAGAGCTGGACATCAATCGGTTGTCTGATTACGACGTGGACCACATCGTTCCACAGTCCTTTCTGAAGGATGACTCCATCGATAACAAGGTGTTGACTCGCAGCGACAAGAACAGAGGGAAGTCAGATAATGTGCCATCGGAGGAGGTCGTGAAGAAGATGAAGAATTACTGGCGGCAGCTCCTGAATGCGAAGCTGATTACCCAGAGAAAGTTTGACAATCTCACTAAAGCCGAGCGCGGCGGACTCTCAGAGCTGGATAAGGCTGGATTCATCAAACGGCAGCTGGTCGAGACTCGGCAGATTACCAAGCACGTGGCGCAGATCCTGGACTCCCGCATGAACACTAAATACGACGAGAACGATAAGCTCATCCGGGAAGTGAAGGTGATTACCCTGAAAAGCAAACTTGTGTCGGACTTTCGGAAGGACTTTCAGTTTTACAAAGTGAGAGAAATCAACAACTACCATCACGCGCATGACGCATACCTCAACGCTGTGGTCGGCACCGCCCTGATCAAGAAGTACCCTAAACTTGAATCGGAGTTTGTGTACGGAGACTACAAGGTCTACGACGTGAGGAAGATGATAGCCAAGTCCGAACAGGAAATCGGGAAAGCAACTGCGAAATACTTCTTTTACTCAAACATCATGAACTTCTTCAAGACTGAAATTACGCTGGCCAATGGAGAAATCAGGAAGAGGCCACTGATCGAAACTAACGGAGAAACGGGCGAAATCGTGTGGGACAAGGGCAGGGACTTCGCAACTGTTCGCAAAGTGCTCTCTATGCCGCAAGTCAATATTGTGAAGAAACCGAAGTGCAAACCGGCGGATTTTCAAAGGAATCGATCCTCCCAAAGAGAAATAGCGACAAGCTCATTGCACGCAAGAAAGACTGGGACCCGAAGAAGTACGGAGGATTCGATTCGCCGACTGTCGCATACTCCGTCCTCGTGGTGGCCAAGGTGGAGAAGGGAAAGAGCAAGAAGCTCAAATCCGTCAAAGAGCTGCTGGGGATTACCATCATGGAACGATCCTCGTTCGAGAAGAACCCGATTGATTTCCTGGAGGCGAAGGGTTACAAGGAGGTGAAGAAGGATCTGATCATCAAACTGCCCAAGTACTCACTGTTCGAACTGGAAAATGGTCGGAAGCGCATGCTGGCTTCGGCCGGAGAACTCCAGAAAGGAAATGAGCTGGCCTTGCCTAGCAAGTACGTCAACTTCCTCTATCTTGCTTCGCACTACGAGAAACTCAAAGGGTCACCGGAAGATAACGAACAGAAGCAGCTTTTCGTGGAGCAGCACAAGCATTATCTGGATGAAATCATCGAACAAATCTCCGAGTTTTCAAAGCGCGTGATCCTCGCCGACGCCAACCTCGACAAAGTCCTGTCGGCCTACAATAAGCATAGAGATAAGCCGATCAGAGAACAGGCCGAGAACATTAT | |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | CCACTTGTTCACCCTGACTAACCTGGGAGCTCCAGCCGCCTTCAAGTACTTCGATACTAC-TATCGACCGCAAAAGATACACGTCCACCAAGGA AGTTCTGGACGCGACCCTGATCCACCAAAGCATCACTGGACTCTACGAAACTAGGATC-GATCTGTCGCAGCTGGGTGGCGATGGTGGCGGTGG ATCCTACCCATACGACGTGCCTGACTACGCCTCCGGAGGTGGTGGCCCCAAGAAGAAACG-GAAGGTGTGATAGCTAGCCATCACATTTAAAAG CATCTCAGCCTACCATGAGAATAAGAGAAAGAAAATGAAGATCAATAGCTTATT-CATCTCTTTTTCTTTTTCGTTGGTGTAAAGCCAACACCC TGTCTAAAAAACATAAATTTCTTTAATCATTTTGCCTCTTTTCTCTGTGCTTCAATTAATAAAAAATGGAAAGAACCTCGAG | |
| Cas9 transcript comprising Cas9 ORF using codons with generally high expression in humans | GGGTCCCGCAGTCGGCGTCCAGCGGCTCTGCTTGTTCGTGTGTGTCGTTGCAGGCCTT-ATTCGGATCCATGCCTAAGAAAAAGCGGAAGGT CGACGGGGATAAGAAGTACTCAATCGGGCTGGATATCGGAACTAAT-TCCGTGGGTTGGGCAGTGATCACGGATGAATACAAAGTGCCGTCCAA GAAGTTCAAGGTCCTGGGGAACACCGATAGACACAGCATCAAGAAAAATCTCATCG-GAGCCCTGCTGTTTGACTCCGGCGAAACCGCAGAAGC GACCCGGCTCAAACGTACCGCGAGGCGACGCTACACCCGGCGGAAGAATCGCATCTGC-TATCTGCAAGAGATCTTTTCGAACGAAATGGCAAA GGTCGACGACAGCTTCTTCCACCGCCTGGAAGAATCTTTCCTGGTGGAG-GAGGACAAGAAGCATGAACGGCATCCTATCTTTGGAAACATCGT CGACGAAGTGGCGTACCACGAAAAGTACCCGACCATCTACCATCTGCG-GAAGAAGTTGGTTGACTCAACTGACAAGGCCGACCTCAGATTGAT CTACTTGGCCCTCGCCCATATGATCAAATTCCGCGGACACTTCCTGATCGAAGGCGATCT-GAACCCTGATAACTCCGACGTGGATAAGCTTTT CATTCAACTGGTGCAGACCTACAACCAACTGTTCGAAGAAAACCCAAT-CAATGCTAGCGCGTCGATGCCAAGGCCATCCTGTCCGCCCGGCT GTCGAAGTCGCGGCGCCTCGAAAACCTGATCGCACAGCTGCCGG-GAGAGAAAAAGAACGGACTTTTCGGCAACTTGATCGCTCTCTCACTGGG ACTCACTCCCAATTTCAAGTCCAATTTTGACCTGGCCGAGGACGCGAAGCTGCAACTCT-CAAAGGACACCTACGACGACGACTTGGACAATTT GCTGGCACAAATTGGCGATCAGTACGCG-GATCTGTTCCTTGCCGCTAAGAACCTTTCGGACGCAATCTTGCTGTCCGATATCCTGCGCGTGAA CACCGAAATAACCAAAGCGCCGCTTAGCGCCTCGATGATTAAGCGGTACGACGAGCAT-CACCAGGATCTCACGCTGCTCAAAGCGCTCGTGAG ACAGCAACTGCCTGAAAAGTACAAGGAGATCTTCTTCGACCAGTC-CAAGAATGGGTACGCAGGGTACATCGATGGAGGCGCTAGCCAGGAAGA GTTCTATAAGTTCATCAAGCCAATCCTGGAAAAGATGGACGGAACCGAAGAACTGCTGGT-CAAGCTGAACAGGGAGGATCTGCTCCGGAAACA GAGAACCTTTGACAACGGATCCATTCCCCACCAGATCCATCTGGGTGAGCTGCACGC-CATCTTGCGGCGCCAGGAGGACTTTTACCCATTCCT CAAGGACAACCGGGAAAAGATCGAGAAAATTCTGACGTTCCGCATCCCGTAT-TACGTGGGCCCACTGGCGCGCGGCAATTCGCGCTTCGCGTG GATGACTAGAAAATCAGAGGAAACCATCACTCCTTGGAATTTCGAGGAAGTTGTGGA-TAAGGGAGCTTCGGCACAAAGCTTCATCGAACGAAT GACCAACTTCGACAAGAATCTCCCAAACGAGAAGGTGCTTCCTAAGCACAGCCTCCTT-TACGAATACTTCACTGTCTACAACGAACTGACTAA AGTGAAATACGTTACTGAAGGAATGAGGAAGCCGGCCTTTCTGTCCG-GAGAACAGAAGAAAGCAATTGTCGATCTGCTGTTCAAGACCAACCG CAAGGTGACCGTCAAGCAGCTTAAAGAGGACTACTTCAAGAA-GATCGAGTGTTTCGACTCAGTGGAAATCAGCGGGTGGAGGACAGATTCAA CGCTTCGCTGGGAACCTATCATGATCTCCTGAAGATCAT-CAAGGACAAGGACTTCCTTGACAACGAGGAGAACGAGGACATCCTGGAAGATAT CGTCCTGACCTTGACCCTTTTCGAGGATCGCGAGATGATCGAGGAGAGGCTTAAGACC-TACGCTCATCTCTTCGACGATAAGGTCATGAAACA ACTCAAGCGCCGCCGGTACACTGGTTGGGGCCGCCTCTCCCGCAAGCTGATCAACGGTAT-TCGCGATAAACAGAGCGGTAAAACTATCCTGGA TTTCCTCAAATCGGATGGCTTCGCTAATCGTAACTTCATGCAATTGATC-CACGACGACAGCCTGACCTTTAAGGAGGACATCCAAAAAGCACA AGTGTCCGGACAGGGAGACTCACTCCATGAACACATCGCGAATCTGGCCGGTTCGCCGGC-GATTAAGAAGGGAATTCTGCAAACTGTGAAGGT GGTCGACGAGCTGGTGAAGGTCATGGGACGGCACAAACCGGAGAATATCGTGATT-GAAATGGCCCGAGAAAACCAGACTACCCAGAAGGGCCA GAAAAACTCCCGCGAAAGGATGAAGCGGATCGAAGAAGGAATCAAGGAGCTGGGCAGCCA-GATCCTGAAAGAGCACCCGGTGGAAAACACGCA GCTGCAGAACGAGAAGCTCTACCTGTACTATTTGCAAAATGGACGGGA-CATGTACGTGGACCAAGAGCTGGACATCAATCGGTTGTCTGATTA CGACGTGGACCACATCGTTCCACAGTCCTTTCTGAAGGATGACTCGATCGA-TAACAAGGTGTTGACTCGCAGCGACAAGAACAGAGGGAAGTC AGATAATGTGCCATCGGAGGAGGTCGTGAAGAAGATGAAGAATTACTGGCGGCAGCTCCT-GAATGCGAAGCTGATTACCCAGAGAAAGTTTGA CAATCTCACTAAAGCCGAGCGCGGCGGACTCTCAGAGCTGGATAAGGCTGGATTCAT-CAAACGCAGCTGGTCGAGACTCGGCAGATTACCAA GCACGTGGCGCAGATCTTGGACTCCCGCATGAACACTAAATACGACGAGAACGATAAGCT-CATCCGGGAAGTGAAGGTGATTACCCTGAAAAG CAAACTTGTGTCGGACTTTCGGAAGGACTTTCAGTTTTACAAAGTGAGAGAAAT-CAACAACTACCATCACGCGCATGACGCATACCTCAACGC | 48 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | TGTGGTCGGTACCGCCCTGATCAAAAAGTACCCTAAACTTGAATCGGAGTTTGTGTACG-GAGACTACAAGGTCTACGACGTGAGGAAGATGAT AGCCAAGTCCGAACAGGAAATCGGAAAGCAACTGCGAAATACTTCTTTTACTCAAACAT-CATGAACTTTTTCAAGACTGAAATTACGCTGGC CAATGGAGAAATCAGGAAGAGGCCACTGATCGAAACTAACG-GAGAAACGGGCGAAATCGTGTGGGACAAGGGCAGGGACTTCGCAACTGTTCG CAAAGTGCTCTCTATGCCGACAAGTCAATATTGTGAAGAAAACCGAAGTGCAAACCGGCG-GATTTTCAAAGGAATCGATCCTCCCAAAGAGAAA TAGCGACAAGCTCATTGCACGCAAGAAAGACTGGGACCCGAAGAAGTACGGAGGATTC-GATTCGCCGACTGTCGCATACTCCGTCCTCGTGGT GGCCAAGGTGGAGAAGGGAAAGAGCAAAAAGCTCAAATCCGTCAAAGAGCTGCTGGGGAT-TACCATCATGGAACGATCCTCGTTCGAGAAGAA CCCGATTGATTTCCTCGAGGCGAAGGGTTACAAGGAGGTGAAGAAGGATCTGATCAT-CAAACTCCCCAAGTACTCACTGTTCGAACTGGAAAA TGGTCGGAAGCGCATGCTGGCTTCGGCCGAGAACTCCAAAAAGGAAAT-GAGCTGGCCTTGCCTAGCAAGTACGTCAACTTCCTCTATCTTGC TTCGCACTACGAAAAACTCAAAGGGTCACCGGAAGA-TAACGAACAGAAGCAGCTTTTCGTGGAGCAGCACAAGCATTATCTGGATGAAATCAT CGAACAAATCTCCGAGTTTTCAAAGCGCGTGATCCTCGCCGACGC-CAACCTCGACAAAGTCCTGTCGGCCTACAATAAGCATAGAGATAAGCC GATCAGAGAACAGGCCGAGAACATTATCCACTTGTTCACCCTGACTAACCTGG-GAGCCCCAGCCGCCTTCAAGTACTTCGATACTACTATCGA TCGCAAAAGATACACGTCCACCAAGGAAGTTCTGGACGCGACCCTGATCCACCAAAGCAT-CACTGGACTCTACGAAACTAGGATCGATCTGTC GCAGCTGGGTGGCGATTGATAGTCTAGCCATCACATTTAAAAGCATCTCAGCCTACCAT-GAGAATAAGAGAAAGAAAATGAAGATCAATAGCT TATTCATCTCTTTTCTTTTCGTTGGTGTAAAGCCAACACCCTGTCTAAAAAACAT-AAATTTCTTTAATCATTTTGCCTCTTTTCTCTGTGC TTCAATTAATAAAAAATGGAAAGAACCTCGAG | |
| Cas9 transcript comprising Kozak sequence with Cas9 ORF using codons with generally high expression in humans | GGGTCCCGCAGTCGGCGTCCAGCGGCTCTGCTTGTTCGTGTGTGTCGTTGCAGGCCTT-ATTCGGATCCGCCACCATGCCTAAGAAAAAGCG GAAGGTCGACGGGGATAAGAAGTACTCAATCGGGCTGGATATCGGAACTAAT-TCCGTGGGTTGGGCAGTGATCACGGATGAATACAAAGTGCC GTCCAAGAAGTTCAAGGTCCTGGGGAACACCGATAGACACAGCATCAAGAAAAATCT-CATCGGAGCCCTGCTGTTTGACTCCGGCGAAACCGC AGAAGCGACCCGGCTCAAACGTACCGCGAGGCGACGCTACACCCGGCGGAAGAATCG-CATCTGCTATCTGCAAGAGATCTTTTCGAACGAAAT GGCAAAGGTCGACGACAGCTTCTTCCACCGCCTGGAAGAATCTTTCCTGGTGGAG-GAGGACAAGAAGCATGAACGGCATCCTATCTTTGGAAA CATCGTCGACGAAGTGGCGTACCACGAAAAGTACCCGACCATCTACCATCTGCG-GAAGAAGTTGGTTGACTCAACTGACAAGGCCGACCTCAG ATTGATCTACTTGGCCCTCGCCCATATGATCAAATTCCGCGGACACTTCCT-GATCGAAGGCGATCTGAACCCTGATAACTCCGACGTGGATAA GCTTTTCATTCAACTGGTGCAGACCTACAACCAACTGTTCGAAGAAAACCCAAT-CAATGCTAGCGCGTCGATGCCAAGGCCATCCTGTCCGC CCGGCTGTCGAAGTCGCGGCGCCTCGAAACCTGATCGCACAGCTGCCGG-GAGAGAAAAAGAACGGACTTTTCGGCAACTTGATCGCTCTCTC ACTGGGACTCACTCCCAATTTCAAGTCCAAT-TTTGACCTGGCCGAGGACGCGAAGCTGCAACTCTCAAAGGACACCTACGACGACGACTTGGA CAATTTGCTGGCACAAATTGGCGATCAGTACGCG-GATCTGTTCCTTGCCGCTAAGAACCTTTCGGACGCAATCTTGCTGTCCGATATCCTGCG CGTGAACACCGAAATAACCAAAGCGCCGCTTAGCGCCCTCGATGAT-TAAGCGGTACGACGAGCATCACCAGGATCTCACGCTGCTCAAAGCGCT CGTGAGACAGCAACTGCCTGAAAAGTACAAGGAGATCTTCTTCGACCAGTC-CAAGAATGGGTACGCAGGGTACATCGATGGAGGCGCTAGCCA GGAAGAGTTCTATAAGTTCATCAAGCCAATCCTGGAAAAGATGGACG-GAACCGAAGAACTGCTGGTCAAGCTGAACAGGGAGGATCTGCTCCG GAAACAGAGAACCTTTGACAACGGATCCATTCCCCACCAGATCCATCTGGGT-GAGCTGCACGCCATCTTGCGGCGCCAGGAGGACTTTTACCC ATTCCTCAAGGACAACCGGGAAAAGATCGAGAAAATTCTGACGTTCCGCATCCCGTAT-TACGTGGGCCCACTGGCGCGCGGCAATTCGCGCTT CGCGTGGATGACTAGAAAATCAGAGGAAACCATCACTCCTTGGAATTTCGAG-GAAGTTGTGGATAAGGGAGCTTCGGCACAAAGCTTCATCGA ACGAATGACCAACTTCGACAAGAATCTCC-CAAACGAGAAGGTGCTTCCTAAGCACAGCCTCCTTTACGAATACTTCACTGTCTACAACGAACT GACTAAAGTGAAATACGTTACTGAAGGAATGAGGAAGCCGGCCTTTCTGTCCG-GAGAACAGAAGAAAGCAATTGTCGATCTGCTGTTCAAGAC CAACCGCAAGGTGACCGTCAAGCAGCTTAAAGAGGACTACTTCAAGAA-GATCGAGTGTTTCGACTCAGTGGAAATCAGCGGGGTGGAGGACAG ATTCAACGCTTCGCTGGGAACCTATCATGATCTCCTGAAGATCAT-CAAGGACAAGGACTTCCTTGACAACGAGGAGAACGAGGACATCCTGGA AGATATCGTCCTGACCTTGACCCTTTTCGAGGATCGCGAGATGATCGAGGAGAGGCTTAA-GACCTACGCTCATCTCTTCGACGATAAGGTCAT GAAACAACTCAAGCGCCGCCGGTACACTGGTTGGGGCCGCCTCTCCCGCAAGCTGAT-CAACGGTATTCGCGATAAACAGAGCGGTAAAACTAT | 49 |

| Description | Sequence | SEQ ID No. |
|---|---|---|
| | CCTGGATTTCCTCAAATCGGATGGCTTCGCTAATCGTAACTTCATGCAATTGATC-<br>CACGACGACAGCCTGACCTTTAAGGAGGACATCCAAAA<br>AGCACAAGTGTCCGGACAGGGAGACTCACTCCATGAACA-<br>CATCGCGAATCTGGCCGGTTCGCCGGCGATTAAGAAGGGAATTCTGCAAACTGT<br>GAAGGTGGTCGACGAGCTGGTGAAGGTCATGGGACGGCACAAACCGGAGAATATCGTGAT-<br>TGAAATGGCCCGAGAAAACCAGACTACCCAGAA<br>GGGCCAGAAAAACTCCCGCGAAAGGATGAAGCGGATCGAAGAAGGAAT-<br>CAAGGAGCTGGGCAGCCAGATCCTGAAAGAGCACCCGGTGGAAAA<br>CACGCAGCTGCAGAACGAGAAGCTCTACCTGTACTATTTGCAAAATGGACGGGA-<br>CATGTACGTGGACCAAGAGCTGGACATCAATCGGTTGTC<br>TGATTACGACGTGGACCACATCGTTCCACAGTCCTTTCTGAAGGATGACTCGATCGA-<br>TAACAAGGTGTTGACTCGCAGCGACAAGAACAGAGG<br>GAAGTCAGATAATGTGCCATCGGAGGAGGTCGTGAAGAAGATGAAGAAT-<br>TACTGGCGGCAGCTCCTGAATGCGAAGCTGATTACCCAGAGAAA<br>GTTTGACAATCTCACTAAAGCCGAGCGCGGCGGACTCTCAGAGCTGGATAAGGCTGGATT-<br>CATCAAACGGCAGCTGGTCGAGACTCGGCAGAT<br>TACCAAGCACGTGGCGCAGATCTTGGACTCCCGCATGAACACTAAATACGACGAGAACGA-<br>TAAGCTCATCCGGGAAGTGAAGGTGATTACCCT<br>GAAAAGCAAACTTGTGTCGGACTTTCGGAAGGACTTTCAGTTTTACAAAGTGAGAGAAAT-<br>CAACAACTACCATCACGCGCATGACGCATACCT<br>CAACGCTGTGGTCGGTACCGCCCTGATCAAAAAGTACCCTAAACTTGAATCG-<br>GAGTTTGTGTACGGAGACTACAAGGTCTACGACGTGAGGAA<br>GATGATAGCCAAGTCCGAACAGGAAATCGGGAAAGCAACTGCGAAATACTTCTTTTACT-<br>CAAACATCATGAACTTTTTCAAGACTGAAATTAC<br>GCTGGCCAATGGAGAAATCAGGAAGAGGCCACTGATCGAAACTAACG-<br>GAGAAACGGGCGAAATCGTGTGGGACAAGGGCAGGGACTTCGCAAC<br>TGTTCGCAAAGTGCTCTCTATGCCGCAAGTCAATATTGT-<br>GAAGAAAACCGAAGTGCAAACCGGCGGATTTTCAAAGGAATCGATCCTCCCAAA<br>GAGAAATAGCGACAAGCTCATTGCACGCAAGAAAGACTGGGACCCGAAGAAGTACGGAG-<br>GATTCGATTCGCCGACTGTCGCATACTCCGTCCT<br>CGTGGTGGCCAAGGTGGAGAAGGGAAAGAGCAAAAAGCTCAAATCCGT-<br>CAAAGAGCTGCTGGGGATTACCATCATGGAACGATCCTCGTTCGA<br>GAAGAACCCGATTGATTTCCTCGAGGCGAAGGGTTACAAGGAGGTGAAGAAGGATCTGAT-<br>CATCAAACTCCCCAAGTACTCACTGTTCGAACT<br>GGAAAATGGTCGGAAGCGCATGCTGGCTTCGGCCGGAGAACTCCAAAAAGGAAAT-<br>GAGCTGGCCTTGCCTAGCAAGTACGTCAACTTCCTCTA<br>TCTTGCTTCGCACTACGAAAAACTCAAAGGGTCACCGGAAGA-<br>TAACGAACAGAAGCAGCTTTTCGTGGAGCAGCACAAGCATTATCTGGATGA<br>AATCATCGAACAAATCTCCGAGTTTTTCAAAGCGCGTGATCCTCGCCGACGC-<br>CAACCTCGACAAAGTCCTGTCGGCCTACAATAAGCATAGAGA<br>TAAGCCGATCAGAGAACAGGCCGAGAACATTATCCACTTGTTCACCCTGACTAACCTGG-<br>GAGCCCCAGCCGCCTTCAAGTACTTCGATACTAC<br>TATCGATCGCAAAAGATACACGTCCACCAAGGAAGTTCTGGACGCGACCCTGATCCAC-<br>CAAAGCATCACTGGACTCTACGAAACTAGGATCGA<br>TCTGTCGCAGCTGGGTGGCGATTGATAGTCTAGCCATCACATTTAAAAGCATCTCAGCC-<br>TACCATGAGAATAAGAGAAAGAAAATGAAGATCA<br>ATAGCTTATTCATCTCTTTTTCTTTTTCGTTGGTGTAAAGCCAACACCCTGTCTAAAAAA-<br>CATAAATTTCTTTAATCATTTTGCCTCTTTTCT<br>CTGTGCTTCAATTAATAAAAAATGGAAAGAACCTCGAG | |
| Cas9 ORF with splice junctions removed; 12.75% U content | ATGGACAAGAAGTACAGCATCGGACTGGACATCGGAACAAACAGCGTCGGATGGGCAGT-<br>CATCACAGACGAATACAAGGTCCCGAGCAAGAAG<br>TTCAAGGTCCTGGGAAACACAGACAGACAGCATCAAGAAGAACCTGATCG-<br>GAGCACTGCTGTTCGACAGCGGAGAAACAGCAGAAGCAACA<br>AGACTGAAGAGAACAGCAAGAAGAAGATACAAGAAGAAAGAACAGAATCTGC-<br>TACCTGCAGGAAATCTTCAGCAACGAAATGGCAAAGGTC<br>GACGACAGCTTCTTCCACcggCTGGAAGAAAGCTTCCTGGTCGAAGAA-<br>GACAAGAAGCACGAAAGACACCCGATCTTCGGAAACATCGTCGAC<br>GAAGTCGCATACCACGAAAAGTACCCGACAATCTACCACCT-<br>GAGAAAGAAGCTGGTCGACAGCACAGACAAGGCAGACCTGAGACTGATCTAC<br>CTGGCACTGGCACACATGATCAAGTTCAGAGGACACTTCCTGATCGAAGGAGACCT-<br>GAACCCGGACAACAGCGACGTCGACAAGCTGTTCATC<br>CAGCTGGTCCAGACATACAACCAGCTGTTCGAAGAAAACCCGATCAACGCAAGCG-<br>GAGTCGACGCAAAGGCAATCCTGAGCGCAAGACTGAGC<br>AAGAGCAGAAGACTGGAAAACCTGATCGCACAGCTGCCGG-<br>GAGAAAAGAAGAACGGACTGTTCGGAAACCTGATCGCACTGAGCCTGGGACTG<br>ACACCGAACTTCAAGAGCAACTTCGACCTGGCAGAAGACGCAAAGCTGCAGCT-<br>GAGCAAGGACACATACGACGACGACCTGGACAACCTGCTG<br>GCACAGATCGGAGACCAGTACGCAGACCTGTTCCTGGCAGCAAAGAACCT-<br>GAGCGACGCAATCCTGCTGAGCGACATCCTGAGAGTCAACACA<br>GAAATCACAAAGGCACCGCTGAGCGCAAGCATGATCAAGAGATACGACGAACAC-<br>CACCAGGACCTGACACTGCTGAAGGCACTGGTCAGACAG<br>CAGCTGCCGGAAAAGTACAAGGAAATCTTCTTCGACCAGAGCAAGAACGGATACGCAGGA-<br>TACATCGACGGAGGAGCAAGCCAGGAAGAATTC<br>TACAAGTTCATCAAGCCGATCCTGGAAAAGATGGACGGAACAGAAGAACTGCTGGT-<br>CAAGCTGAACAGAGAAGACCTGCTGAGAAAGCAGAGA | 50 |

Sequence Table

The following sequence table provides a listing of sequences disclosed herein. It is understood that if a DNA sequence (comprising Ts) is referenced with respect to an RNA, then Ts should be replaced with Us(which may be modified or unmodified depending on the context), and vice versa.

| Description | Sequence | SEQ ID No. |
| --- | --- | --- |
| | ACATTCGACAACGGAAGCATCCCGCACCAGATCCACCTGGGAGAACTGCACGCAATCCT-GAGAAGACAGGAAGACTTCTACCCGTTCCTGAAG GACAACAGAGAAAAGATCGAAAAGATCCTGACATTCAGAATCCCGTAC-TACGTCGGACCGCTGGCAAGAGGAAACAGCAGATTCGCATGGATG ACAAGAAAGAGCGAAGAAACAATCACACCGTGGAACTTCGAAGAAGTCGTCGACAAGG-GAGCAAGCGCACAGAGCTTCATCGAAAGAATGACA AACTTCGACAAGAACCTGCCGAACGAAAAGGTCCTGCCGAAGCACAGCCTGCTGTACGAATACTTCACAGTCTACAACGAACTGACAAAGGTC AAGTACGTCACAGAAGGAATGAGAAAGCCGGCATTCCTGAGCG-GAGAACAGAAGAAGGCAATCGTCGACCTGCTGTTCAAGACAAACAGAAAG GTCACAGTCAAGCAGCTGAAGGAAGACTACTTCAAGAA-GATCGAATGCTTCGACAGCGTCGAAATCAGCGGAGTCGAAGACAGATTCAACGCA AGCCTGGGAACATACCACGACCTGCTGAAGATCAT-CAAGGACAAGGACTTCCTGGACAACGAAGAAAACGAAGACATCCTGGAAGACATCGTC CTGACACTGACACTGTTCGAAGACAGAGAAATGATCGAAGAAAGACTGAAGACAT-ACGCACACCTGTTCGACGACAAGGTCATGAAGCAGCTG AAGAGAAGAAGATACACAGGATGGGGAAGACTGAGCAGAAAGCTGATCAACGGAATCAGA-GACAAGCAGAGCGGAAAGACAATCCTGGACTTC CTGAAGAGCGACGGATTCGCAAACAGAAACTTCATGCAGCTGATC-CACGACGACAGCCTGACATTCAAGGAAGACATCCAGAAGGCACAGGTC AGCGGACAGGGAGACAGCCTGCACGAACACATCGCAAACCTGGCAGGAAGCCCGGCAAT-CAAGAAGGGAATCCTGCAGACAGTCAAGGTCGTC GACGAACTGGTCAAGGTCATGGGAAGACACAAGCCGGAAAACATCGT-CATCGAAATGGCAAGAGAAAACCAGACAACACAGAAGGGACAGAAG AACAGCAGAGAAAGAATGAAGAGAATCGAAGAAGGAATCAAGGAACTGGGAAGCCA-GATCCTGAAGGAACACCCGGTCGAAAACACACAGCTG CAGAACGAAAAGCTGTACCTGTACTACCTGCAaAACGGAAGAGACATGTACGTCGACCAG-GAACTGGACATCAACAGACTGAGCGACTACGAC GTCGACCACATCGTCCCGCAGAGCTTCCTGAAGGACGACAG-CATCGACAACAAGGTCCTGACAAGAAGCGACAAGAACAGAGGAAAGAGCGAC AACGTCCCGAGCGAAGAAGTCGTCAAGAAGATGAAGAACTACTGGAGACAGCTGCT-GAACGCAAAGCTGATCACACAGAGAAAGTTCGACAAC CTGACAAAGGCAGAGAGAGGAGGACTGAGCGAACTGGACAAGGCAGGATTCATCAAGA-GACAGCTGGTCGAAACAAGACAGATCACAAAGCAC GTCGCACAGATCCTGGACAGCAGAATGAACACAAAGTACGACGAAAACGACAAGCT-GATCAGAGAAGTCAAGGTCATCACACTGAAGAGCAAG CTGGTCAGCGACTTCAGAAAGGACTTCCAGTTCTACAAGGTCAGAGAAATCAACAACTAC-CACCACGCACACGACGCATACCTGAACGCAGTC GTCGGAACAGCACTGATCAAGAAGTACCCGAAGCTGGAAAGCGAATTCGTCTACGGAGAC-TACAAGGTCTACGACGTCAGAAAGATGATCGCA AAGAGCGAACAGGAAATCGGAAAGGCAACAGCAAAGTACTTCTTCTACAGCAACATCAT-GAACTTCTTCAAGACAGAAATCACACTGGCAAAC GGAGAAATCAGAAAGAGACCGCTGATCGAAACAAACGGAGAAACAG-GAGAAATCGTCTGGGACAAGGGAAGAGACTTCGCAACAGTCAGAAAG GTCCTGAGCATGCCGCAGGTCAACATCGTCAAGAAGACAGAAGTCCAGACAGGAGGAT-TCAGCAAGGAAAGCATCCTGCCGAAGAGAAACAGC GACAAGCTGATCGCAAGAAAGAAGGACTGGGACCCGAAGAAGTACGAGGAT-TCGACAGCCCGACAGTCGCATACAGCGTCCTGGTCGTCGCA AAGGTCGAAAAGGGAAAGAGCAAGAAGCTGAAGAGCGTCAAGGAACTGCTGGGAAT-CACAATCATGGAAAGAAGCAGCTTCGAAAAGAACCCG ATCGACTTCCTGGAAGCAAAGGGATACAAGGAAGTCAAGAAGGACCTGATCAT-CAAGCTGCCGAAGTACAGCCTGTTCGAACTGGAAAACGGA AGAAAGAGAATGCTGGCAAGCGCAGGAGAACTGCAGAAGG-GAAACGAACTGGCACTGCCGAGCAAGTACGTCAACTTCCTGTACCTGGCAAGC CACTACGAAAAGCTGAAGGGAAGCCCGGAA-GACAACGAACAGAAGCAGCTGTTCGTCGAACAGCACAAGCACTACCTGGACGAAATCATCGAA CAGATCAGCGAATTCAGCAAGAGAGTCATCCTGGCAGACGCAAACCTGGACAAGGTCCT-GAGCGCATACAACAAGCACAGAGACAAGCCGATC AGAGAACAGGCAGAAAACATCATCCACCTGTTCACACTGACAAACCTGG-GAGCACCGGCAGCATTCAAGTACTTCGACACAACAATCGACAGA AAGAGATACACAAGCACAAAGGAAGTCCTGGACGCAACACTGATCCACCAGAGCAT-CACAGGACTGTACGAAACAAGAATCGACCTGAGCCAG CTGGGAGGAGACGGAGGAGGAAGCCCGAAGAAGAAGAGAAAGGTCTAG | |
| Cas9 transcript with 5' UTR of | GGGTCCCGCAGTCGGCGTCCAGCGGCTCTGCTTGTTCGTGTGTGTCGTTGCAGGCCTT-ATTCGGATCCGCCACCATGGACAAGAAGTACAG CATCGGACTGGACATCGGAACAAACAGCGTCGGATGGGCAGTCATCACAGACGAATA-CAAGGTCCCGAGCAAGAAGTTCAAGGTCCTGGGAAA CACAGACAGACACAGCATCAAGAAGAACCTGATCGGAGCACTGCTGTTCGACAGCG-GAGAAACAGCAGAAGCAACAAGACTGAAGAGAACAGC AAGAAGAAGATACACAAGAAGAAAGAACAGAATCTGCTACCTGCAG-GAAATCTTCAGCAACGAAATGGCAAAGGTCGACGACAGCTTCTTCCA CcggCTGGAAGAAAGCTTCCTGGTCGAAGAAGACAAGAAGCACGAAAAGACACCC-GATCTTCGGAAACATCGTCGACGAAGTCGCATACCACGA AAAGTACCCGACAATCTACCACCTGAGAAAGAAGCTGGTCGACAGCACAGACAAGGCA-GACCTGAGACTGATCTACCTGGCACTGGCACACAT | 51 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| HSD, ORF corresponding to SEQ ID NO: 50, Kozak sequence, and 3' UTR of ALB | GATCAAGTTCAGAGGACACTTCCTGATCGAAGGAGACCT-GAACCCGGACAACAGCGACGTCGACAAGCTGTTCATCCAGCTGGTCCAGACATA CAACCAGCTGTTCGAAGAAACCCGATCAACGCAAGCGGAGTCGACGCAAAGGCAATCCT-GAGCGCAAGACTGAGCAAGAGCAGAAGACTGGA AAACCTGATCGCACAGCTGCCGGGAGAAAAGAAGAACGGACTGTTCGGAAACCT-GATCGCACTGAGCCTGGGACTGACACCGAACTTCAAGAG CAACTTCGACCTGGCAGAAGACGCAAAGCTGCAGCTGAGCTGCAAGGACACAT-ACGACGACGACCTGGACAACCTGCTGGCACAGATCGGAGACCA GTACGCAGACCTGTTCCTGGCAGCAAAGAACCTGAGCGACGCAATCCTGCTGAGCGA-CATCCTGAGAGTCAACACAGAAATCACAAAGGCACC GCTGAGCGCAAGCATGATCAAGAGATACGACGAACACCACCAGGACCTGACACTGCT-GAAGGCACTGGTCAGACAGCAGCTGCCGGAAAAGTA CAAGGAAATCTTCTTCGACCAGAGCAAGAACGGATACGCAGGATACATCGACGGAG-GAGCAAGCCAGGAAGAATTCTACAAGTTCATCAAGCC GATCCTGGAAAAGATGGACGGAACAGAAGAACTGCTGGTCAAGCTGAACAGAGAA-GACCTGCTGAGAAAGCAGAGAACATTCGACAACGGAAG CATCCCGCACCAGATCCACCTGGGAGAACTGCACGCAATCCTGAGAAGACAGGAA-GACTTCTACCCGTTCCTGAAGGACAACAGAGAAAAGAT CGAAAAGATCCTGACATTCAGAATCCCGTACTACGTCGGACCGCTGGCAAGAG-GAAACAGCAGATTCGCATGGATGACAAGAAAGAGCGAAGA AACAATCACACCGTGGAACTTCGAAGAAGTCGTCGACAAGGGAGCAAGCGCACAGAGCTT-CATCGAAAGAATGACAAACTTCGACAAGAACCT GCCGAACGAAAAGGTCCTGCCGAAGCACAGCCTGCTGTACGAATACTTCACAGTCTA-CAACGAACTGACAAAGGTCAAGTACGTCACAGAAGG AATGAGAAAGCCGGCATTCCTGAGCGGAGAACAGAAGAAGGCAATCGTCGACCTGCTGTT-CAAGACAAACAGAAAGGTCACAGTCAAGCAGCT GAAGGAAGACTACTTCAAGAAGATCGAATGCTTCGACAGCGTCGAAATCAGCG-GAGTCGAAGACAGATTCAACGCAAGCCTGGGAACATACCA CGACCTGCTGAAGATCATCAAGGACAAGGACTTCCTGGACAACGAAGAAAACGAAGA-CATCCTGGAAGACATCGTCCTGACACTGACACTGTT CGAAGACAGAGAAATGATCGAAGAAAGACTGAAGACAT-ACGCACACCTGTTCGACGACAAGGTCATGAAGCAGCTGAAGAGAAGAAGATACAC AGGATGGGGAAGACTGAGCAGAAAGCTGATCAACGGAATCAGAGACAAGCAGAGCGGAAA-GACAATCCTGGACTTCCTGAAGAGCGACGGATT CGCAAACAGAAACTTCATGCAGCTGATCCACGACGACAGCCTGACATTCAAGGAAGA-CATCCAGAAGGCACAGGTCAGCGGACAGGGAGACAG CCTGCACGAACACATCGCAAACCTGGCAGGAAGCCCGGCAATCAAGAAGGGAATCCTGCA-GACAGTCAAGGTCGTCGACGAACTGGTCAAGGT CATGGGAAGACACAAGCCGGAAAACATCGTCATCGAAATGGCAAGAGAAAACCA-GACAACACAGAAGGGACAGAAGAACAGCAGAGAAAGAAT GAAGAGAATCGAAGAAGGAATCAAGGAACTGGGAAGCCAGATCCT-GAAGGAACACCCGGTCGAAAACACACAGCTGCAGAACGAAAAGCTGTA CCTGTACTACCTGCAaAACGGAAGAGACATGTACGTCGACCAGGAACTGGACATCAACA-GACTGAGCGACTACGACGTCGACCACATCGTCCC GCAGAGCTTCCTGAAGGACGACAG-CATCGACAACAAGGTCCTGACAAGAAGCGACAAGAACAGAGGAAAGAGCGACAACGTCCCGAGCGAAGA AGTCGTCAAGAAGATGAAGAACTACTGGAGACAGCTGCTGAACGCAAAGCTGAT-CACACAGAGAAAGTTCGACAACCTGACAAAGGCAGAGAG AGGAGGACTGAGCGAACTGGACAAGGCAGGATTCATCAAGAGACAGCTGGTCGAAACAA-GACAGATCACAAAGCACGTCGCACAGATCCTGGA CAGCAGAATGAACACAAAGTACGACGAAAACGACAAGCTGATCAGAGAAGTCAAGGTCAT-CACACTGAAGAGCAAGCTGGTCAGCGACTTCAG AAAGGACTTCCAGTTCTACAAGGTCAGAGAAATCAACAACTACCACCACGCACACGACG-CATACCTGAACGCAGTCGTCGGAACAGCACTGAT CAAGAAGTACCCGAAGCTGGAAAGCGAATTCGTCTACGGAGACTACAAGGTC-TACGACGTCAGAAAGATGATCGCAAAGAGCGAACAGGAAAT CGGAAAGGCAACAGCAAAGTACTTCTTCTACAGCAACATCATGAACTTCTTCAA-GACAGAAATCACACTGGCAAACGGAGAAATCAGAAAGAG ACCGCTGATCGAAACAAACGGAGAAACAGGAGAAATCGTCTGGGACAAGGGAAGA-GACTTCGCAACAGTCAGAAAGGTCCTGAGCATGCCGCA GGTCAACATCGTCAAGAAGACAGAAGTCCAGACAGGAGGAT-TCAGCAAGGAAAGCATCCTGCCGAAGAGAAACAGCGACAAGCTGATCGCAAG AAAGAAGGACTGGGACCCGAAGAAGTACGAGGATTCGACAGCCCGACAGTCGCATA-CAGCGTCCTGGTCGTCGCAAAGGTCGAAAAGGGAAA GAGCAAGAAGCTGAAGAGCGTCAAGGAACTGCTGGGAATCACAATCATG-GAAAGAAGCAGCTTCGAAAAGAACCCGATCGACTTCCTGGAAGC AAAGGGATACAAGGAAGTCAAGAAGGACCTGATCATCAAGCTGCCGAAGTA-CAGCCTGTTCGAACTGGAAAACGGAAGAAAGAGAATGCTGGC AAGCGCAGGAGAACTGCAGAAGGGAAACGAACTGGCACTGCCGAGCAAGTACGT-CAACTTCCTGTACCTGGCAAGCCACTACGAAAAGCTGAA GGGAAGCCCGGAAGACAACGAACAGAAGCAGCTGTTCGTCGAACAGCACAAGCAC-TACCTGGACGAAATCATCGAACAGATCAGCGAATTCAG CAAGAGAGTCATCCTGGCAGACGCAAACCTGGACAAGGTCCTGAGCGCATA-CAACAAGCACAGAGACAAGCCGATCAGAGAACAGGCAGAAAA CATCATCCACCTGTTCACACTGACAAACCTGGGAGCACCGGCAGCATT-CAAGTACTTCGACACAACAATCGACAGAAAGAGATACACAAGCAC | |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | AAAGGAAGTCCTGGACGCAACACTGATCCACCAGAGCAT-CACAGGACTGTACGAAACAAGAATCGACCTGAGCCAGCTGGGAGGAGACGGAGGAGGAAGCCCGAAGAAGAAGAGAAAGGTCTAGCTAGCCATCACATT-TAAAAGCATCTCAGCCTACCATGAGAATAAGAGAAAGAAAATGAAGATCAATAGCTTATTCATCTCTTTTTCTTTTTCGTTGGTGTAAAGC-CAACACCCTGTCTAAAAAACATAAATTTCTTTAATCATTTTGCCTCTTTTCTCTGTGCTTCAATTAATAAAAAATGGAAAGAACCTCGAG | |
| Cas9 ORF with minimal uridine codons frequently used in humans in general; 12.75% U content | ATGGACAAGAAGTACAGCATCGGCCTGGACATCGGCACCAACAGCGTGGGCTGGGCCGT-GATCACCGACGAGTACAAGGTGCCCAGCAAGAAGTTCAAGGTGCTGGGCAACACCGACAGACACAGCATCAAGAAGAACCT-GATCGGCGCCCTGCTGTTCGACAGCGGCGAGACCGCCGAGGCCACCAGACTGAAGAGAACCGCCAGAAGAAGATACACCAGAAGAAAGAACAGAATCTGC-TACCTGCAGGAGATCTTCAGCAACGAGATGGCCAAGGTGGACGACAGCTTCTTCCACAGACTGGAGGAGAGCTTCCTGGTGGAG-GAGGACAAGAAGCACGAGAGACACCCCATCTTCGGCAACATCGTGGACGAGGTGGCCTACCACGAGAAGTACCCCACCATCTACCACCT-GAGAAAGAAGCTGGTGGACAGCACCGACAAGGCCGACCTGAGACTGATCTACCTGGCCCTGGCCCACATGATCAAGTTCAGAGGCCACTTCCTGATCGAGGGCGACCT-GAACCCCGACAACAGCGACGTGGACAAGCTGTTCATCCAGCTGGTGCAGACCTACAACCAGCTGTTCGAGGAGAACCCCAT-CAACGCCAGCGGCGTGGACGCCAAGGCCATCCTGAGCGCCAGACTGAGCAAGAGCAGAAGACTGGAGAACCT-GATCGCCCAGCTGCCCGGCGAGAAGAAGAACGGCCTGTTCGGCAACCTGATCGCCCTGAGCCTGGGCCTGACCCCCAACTTCAAGAGCAACTTCGACCTGGCCGAGGACGCCAAGCTGCAGCT-GAGCAAGGACACCTACGACGACGACCTGGACAACCTGCTGGCCCAGATCGGCGACCAGTACGCCGACCTGTTCCTGGCCGCCAAGAACCTGAGCGACGC-CATCCTGCTGAGCGACATCCTGAGAGTGAACACCGAGATCACCAAGGCCCCCCTGAGCGCCAGCATGATCAAGAGATACGACGAGCAC-CACCAGGACCTGACCCTGCTGAAGGCCCTGGTGAGACAGCAGCTGCCCGAGAAGTACAAGGAGATCTTCTTCGACCAGAGCAAGAACGGCTACGCCGGC-TACATCGACGGCGGCGCCAGCCAGGAGGAGTTCTACAAGTTCATCAAGCCCATCCTGGAGAAGATGGACGGCACCGAGGAGCTGCTGGT-GAAGCTGAACAGAGAGGACCTGCTGAGAAAGCAGAGAACCTTCGACAACGGCAGCATCCCCCACCAGATCCACCTGGGCGAGCTGCACGCCATCCT-GAGAAGACAGGAGGACTTCTACCCCTTCCTGAAGGACAACAGAGAGGAAGATCGAGAAGATCCTGACCTTCAGAATCCCCTAC-TACGTGGGCCCCCTGGCCAGAGGCAACAGCAGATTCGCCTGGATGACCAGAAAGAGCGAGGAGACCATCACCCCCTGGAACTTCGAG-GAGGTGGTGGACAAGGGCGCCAGCGCCCAGAGCTTCATCGAGAGAATGACCAACTTCGACAAGAACCTGCCCAACGAGAAGGTGCTGCC-CAAGCACAGCCTGCTGTACGAGTACTTCACCGTGTACAACGAGCTGACCAAGGTGAAGTACGTGACCGAGGGCATGAGAAAGCCCGCCTTCCTGAGCGGCGAGCAGAAGAAGGC-CATCGTGGACCTGCTGTTCAAGACCAACAGAAAGGTGACCGTGAAGCAGCTGAAGGAGGACTACTTCAAGAAGATCGAGTGCTTCGACAGCGTG-GAGATCAGCGGCGTGGAGGACAGATTCAACGCCAGCCTGGGCACCTACCACGACCTGCTGAAGATCAT-CAAGGACAAGGACTTCCTGGACAACGAGGAGAACGAGGACATCCTGGAGGACATCGTGCTGACCCTGACCCTGTTCGAGGACAGAGAGATGATCGAGGAGAGACTGAAGACCTACGCC-CACCTGTTCGACGACAAGGTGATGAAGCAGCTGAAGAGAAGAAGATACACCGGCTGGGGCAGACTGAGCAGAAAGCTGATCAACGGCATCAGA-GACAAGCAGAGCGGCAAGACCATCCTGGACTTCCTGAAGAGCGACGGCTTCGCCAACAGAAACTTCATGCAGCTGATC-CACGACGACAGCCTGACCTTCAAGGAGGACATCCAGAAGGCCCAGGTGAGCGGCCAGGGCGACAGCCTGCACGAGCACATCGCCAACCTGGCCGGCAGCCCCGCCAT-CAAGAAGGGCATCCTGCAGACCGTGAAGGTGGTGGACGAGCTGGTGAAGGTGATGGGCAGACACAAGCCCGAGAACATCGT-GATCGAGATGGCCAGAGAGAACCAGACCACCCAGAAGGGCCAGAAGAACAGCAGAGAGAGAATGAAGAGAATCGAGGAGGGCATCAAGGAGCTGGGCAGCCA-GATCCTGAAGGAGCACCCCGTGGAGAACACCCAGCTGCAGAACGAGAAGCTGTACCTGTACTACCTGCAGAACGGCAGAGACATGTACGTGGACCAG-GAGCTGGACATCAACAGACTGAGCGACTACGACGTGGACCACATCGTGCCCCAGAGCTTCCTGAAGGACGACAG-CATCGACAACAAGGTGCTGACCAGAAGCGACAAGAACAGAGGCAAGAGCGACAACGTGCCCAGCGAGGAGGTGGTGAAGAAGATGAAGAACTACTGGAGACAGCTGCT-GAACGCCAAGCTGATCACCCAGAGAAAGTTCGACAACCTGACCAAGGCCGAGAGAGGCGGCCTGAGCGAGCTGGACAAGGCCGGCTTCATCAAGA-GACAGCTGGTGGAGACCAGACAGATCACCAAGCACGTGGCCCAGATCCTGGACAGCAGAATGAACACCAAGTACGACGAGAACGACAAGCT-GATCAGAGAGGTGAAGGTGATCACCCTGAAGAGCAAGCTGGTGAGCGACTTCAGAAAGGACTTCCAGTTCTACAAGGTGAGAGAGATCAACAACTAC-CACCACGCCCACGACGCCTACCTGAACGCCGTGGTGGGCACCGCCCTGATCAAGAAGTACCCCAAGCTGGAGAGCGAGTTCGTGTACGGCGAC-TACAAGGTGTACGACGTGAGAAAGATGATCGCCAAGAGCGAGCAGGAGATCGGCAAGGCCACCGCCAAGTACTTCTTCTACAGCAACATCAT-GAACTTCTTCAAGACCGAGATCACCCTGGCCAAC | 52 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | GGCGAGATCAGAAAGAGACCCCTGATCGAGACCAACGGCGA-GACCGGCGAGATCGTGTGGGACAAGGGCAGAGACTTCGCCACCGTGAGAAAG GTGCTGAGCATGCCCCAGGTGAACATCGTGAAGAAGACCGAGGTGCA-GACCGGCGGCTTCAGCAAGGAGAGCATCCTGCCCAAGAGAAACAGC GACAAGCTGATCGCCAGAAAGAAGGACTGGGACCC-CAAGAAGTACGGCGGCTTCGACAGCCCCACCGTGGCCTACAGCGTGCTGGTGGTGGCC AAGGTGGAGAAGGGCAAGAGCAAGAAGCTGAAGAGCGTGAAGGAGCTGCTGGGCATCAC-CATCATGGAGAGAAGCAGCTTCGAGAAGAACCCC ATCGACTTCCTGGAGGCCAAGGGCTACAAGGAGGTGAAGAAGGACCTGATCAT-CAAGCTGCCCAAGTACAGCCTGTTCGAGCTGGAGAACGGC AGAAAGAGAATGCTGGCCAGCGCCGGCGAGCTGCAGAAGGGCAACGAGCTGGCCCTGCCCAGCAAGTACGTGAACTTCCTGTACCTGGCCAGC CACTACGAGAAGCTGAAGGGCAGCCCCGAGGACAACGAGCAGAAGCAGCTGTTCGTG-GAGCAGCACAAGCACTACCTGGACGAGATCATCGAG CAGATCAGCGAGTTCAGCAAGAGAGTGATCCTGGCCGACGCCAACCTGGACAAGGTGCT-GAGCGCCTACAACAAGCACAGAGACAAGCCCATC AGAGAGCAGGCCGAGAACATCATCCACCTGTTCACCCTGAC-CAACCTGGGCGCCCCCGCCGCCTTCAAGTACTTCGACACCACCATCGACAGA AAGAGATACACCAGCACCAAGGAGGTGCTGGACGCCACCCTGATCCACCAGAGCAT-CACCGGCCTGTACGAGACCAGAATCGACCTGAGCCAG CTGGGCGGCGACGGCGGCGGCAGCCCCAAGAAGAAGAGAAAGGTGTGA | |
| Cas9 transcript with 5' UTR of HSD, ORF corresponding to SEQ ID NO: 52, Kozak sequence, and 3' UTR of ALB | GGGTCCCGCAGTCGGCGTCCAGCGGCTCTGCTTGTTCGTGTGTGTCGTTGCAGGCCTT-ATTCGGATCCGCCACCATGGACAAGAAGTACAG CATCGGCCTGGACATCGGCACCAACAGCGTGGGCTGGGCCGTGATCACCGACGAGTA-CAAGGTGCCCAGCAAGAAGTTCAAGGTGCTGGGCAA CACCGACAGACACAGCATCAAGAAGAACCTGATCGGCGCCCTGCTGTTCGACAGCGGCGA-GACCGCCGAGGCCACCAGACTGAAGAGAACCGC CAGAAGAAGATACACCAGAAGAAAGAACAGAATCTGCTACCTGCAG-GAGATCTTCAGCAACGAGATGGCCAAGGTGGACGACAGCTTCTTCCA CAGACTGGAGGAGAGCTTCCTGGTGGAGGAGGACAAGAAGCACGAGAGACACCC-CATCTTCGGCAACATCGTGGACGAGGTGGCCTACCACGA GAAGTACCCCACCATCTACCACCT-GAGAAAGAAGCTGGTGGACAGCACCGACAAGGCCGACCTGAGACTGATCTACCTGGCCCTGGCCCACAT GATCAAGTTCAGAGGCCACTTCCTGATCGAGGGCGACCT-GAACCCCGACAACAGCGACGTGGACAAGCTGTTCATCCAGCTGGTGCAGACCTA CAACCAGCTGTTCGAGGAGAACCCCATCAACGCCAGCGCGTGGACGCCAAGGCCATCCT-GAGCGCCAGACTGAGCAAGAGCAGAAGACTGGA GAACCTGATCGCCCAGCTGCCCGGCGAGAAGAAGAACGGCCTGTTCGGCAACCT-GATCGCCCTGAGCCTGGGCCTGACCCCCAACTTCAAGAG CAACTTCGACCTGGCCGAGGACGCCAAGCTGCAGCTGAGCAAGGACACC-TACGACGACGACCTGGACAACCTGCTGGCCCAGATCGGCGACCA GTACGCCGACCTGTTCCTGGCCGCCAAGAACCTGAGCGACGCCATCCTGCTGAGCGA-CATCCTGAGAGTGAACACCGAGATCACCAAGGCCCC CCTGAGCGCCAGCATGATCAAGAGATACGACGAGCACCACCAGGACCTGACCCTGCT-GAAGGCCCTGGTGAGACAGCAGCTGCCCGAGAAGTA CAAGGAGATCTTCTTCGACCAGAGCAAGAACGGCTACGCCGGCTA-CATCGACGGCGGCGCCAGCCAGGAGGAGTTCTACAAGTTCATCAAGCC CATCCTGGAGAAGATGGACGGCACCGAGGAGCTGCTGGTGAAGCT-GAACAGAGAGGACCTGCTGAGAAAGCAGAGAACCTTCGACAACGGCAG CATCCCCCACCAGATCACCTGGGCGAGCTGCACGCCATCCTGAGAAGACAG-GAGGACTTCTACCCCTTCCTGAAGGACAACAGAGAGAAGAT CGAGAAGATCCTGACCTTCAGAATCCCCTAC-TACGTGGGCCCCCTGGCCAGAGGCAACAGCAGATTCGCCTGGATGACCAGAAAGAGCGAGGA GACCATCACCCCCTGGAACTTCGAGGAGGTGGTGGACAAGGGCGCCAGCGCCCAGAGCTT-CATCGAGAGAATGACCAACTTCGACAAGAACCT GCCCAACGAGAAGGTGCTGCCCAAGCACAGCCTGCTGTACGAGTACTTCACCGTGTA-CAACGAGCTGACCAAGGTGAAGTACGTGACCGAGGG CATGAGAAAGCCCGCCTTCCTGAGCGGCGAGCAGAAGAAGGCCATCGTGGACCTGCTGTT-CAAGACCAACAGAAAGGTGACCGTGAAGCAGCT GAAGGAGGACTACTTCAAGAAGATCGAGTGCTTCGACAGCGTGGAGATCAGCGGCGTG-GAGGACAGATTCAACGCCAGCCTGGGCACCTACCA CGACCTGCTGAAGATCATCAAGGACAAGGACTTCCTGGACAACGAGGAGAACGAGGA-CATCCTGGAGGACATCGTGCTGACCCTGACCCTGTT CGAGGACAGAGAGATGATCGAGGAGAGACTGAAGACCTACGCC-CACCTGTTCGACGACAAGGTGATGAAGCAGCTGAAGAGAAGAAGATACAC CGGCTGGGGCAGACTGAGCAGAAAGCTGATCAACGGCATCAGAGACAAGCAGAGCGGCAA-GACCATCCTGGACTTCCTGAAGAGCGACGGCTT CGCCAACAGAAACTTCATGCAGCTGATCCACGACGACAGCCTGACCTTCAAGGAGGA-CATCCAGAAGGCCCAGGTGAGCGGCCAGGGCGACAG CCTGCACGAGCACATCGCCAACCTGGCCGGCAGCCCCGCCATCAAGAAGGGCATCCTGCA-GACCGTGAAGGTGGTGGACGAGCTGGTGAAGGT GATGGGCAGACACAAGCCCGAGAACATCGTGATCGAGATGGCCAGAGAGAACCAGAC-CACCCAGAAGGGCCAGAAGAACAGCAGAGAGAGAAT GAAGAGAATCGAGGAGGGCATCAAGGAGCTGGGCAGCCAGATCCT-GAAGGAGCACCCCGTGGAGAACACCCAGCTGCAGAACGAGAAGCTGTA | 53 |

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | CCTGTACTACCTGCAGAACGGCAGAGACATGTACGTGGACCAGGAGCTGGACATCAACA-GACTGAGCGACTACGACGTGGACCACATCGTGCCCCAGAGCTTCCTGAAGGACGACAG-CATCGACAACAAGGTGCTGACCAGAAGCGACAAGAACAGAGGCAAGAGCGACAACGTGCCCAGCGAGGAGGTGGTGAAGAAGATGAAGAACTACTGGAGACAGCTGCTGAACGCCAAGCTGAT-CACCCAGAGAAAGTTCGACAACCTGACCAAGGCCGAGAGAGGCGGCCTGAGCGAGCTGGACAAGGCCGGCTTCATCAAGAGACAGCTGGTGGAGACCA-GACAGATCACCAAGCACGTGGCCCAGATCCTGGACAGCAGAATGAACACCAAGTACGACGAGAACGACAAGCTGATCAGAGAGGTGAAGGTGAT-CACCCTGAAGAGCAAGCTGGTGAGCGACTTCAGAAAGGACTTCCAGTTCTACAAGGTGAGAGAGATCAACAACTACCACCACGCC-CACGACGCCTACCTGAACGCCGTGGTGGGCACCGCCCTGATCAAGAAGTACCCCAAGCTGGAGAGCGAGTTCGTGTACGGCGACTACAAGGTGTACGACGT-GAGAAAGATGATCGCCAAGAGCGAGCAGGAGATCGGCAAGGCCACCGCCAAGTACTTCTTCTACAGCAACATCATGAACTTCTTCAA-GACCGAGATCACCCTGGCCAACGGCGAGATCAGAAAGAGACCCCTGATCGAGACCAACGGCGAGACCGGCGAGATCGTGTGGGACAAGGGCAGA-GACTTCGCCACCGTGAGAAAGGTGCTGAGCATGCCCCAGGTGAACATCGTGAAGAAGACCGAGGTGCAGACCGGCGGCTTCAGCAAGGAGAG-CATCCTGCCCAAGAGAAACAGCGACAAGCTGATCGCCAGAAAGAAGGACTGGGACCCCAAGAAGTACGGCGGCTTCGACAGCCCCACCGTGGCCTA-CAGCGTGCTGGTGGTGGCCAAGGTGGAGAAGGGCAAGAGCAAGAAGCTGAAGAGCGTGAAGGAGCTGCTGGGCATCACCATCATG-GAGAGAAGCAGCTTCGAGAAGAACCCCATCGACTTCCTGGAGGCCAAGGGCTACAAGGAGGTGAAGAAGGACCTGATCATCAAGCTGCCCAAGTA-CAGCCTGTTCGAGCTGGAGAACGGCAGAAAGAGAATGCTGGCCAGCGCCGGCGAGCTGCAGAAGGGCAACGAGCTGGCCCTGCCCAGCAAGTACGT-GAACTTCCTGTACCTGGCCAGCCACTACGAGAAGCTGAAGGGCAGCCCCGAGGACAACGAGCAGAAGCAGCTGTTCGTGGAGCAGCACAAGCAC-TACCTGGACGAGATCATCGAGCAGATCAGCGAGTTCAGCAAGAGAGTGATCCTGGCCGACGCCCAACCTGGACAAGGTGCTGAGCGCCTA-CAACAAGCACAGAGACAAGCCCATCAGAGAGCAGGCCGAGAACATCATCCACCTGTTCACCCTGACCAACCTGGGCGCCCCCGCCGCCTT-CAAGTACTTCGACACCACCATCGACAGAAAGAGATACACCAGCACCAAGGAGGTGCTGGACGCCACCCTGATCCACCAGAGCATCACCGGCCTGTACGA-GACCAGAATCGACCTGAGCCAGCTGGGCGGCGACGGCGGCGGCAGCCCCAAGAAGAAGAGAAAGGTGTGACTAGCCATCACATT-TAAAAGCATCTCAGCCTACCATGAGAATAAGAGAAAGAAAATGAAGATCAATAGCTTATTCATCTCTTTTTCTTTTTCGTTGGTGTAAAGC-CAACACCCTGTCTAAAAAACATAAATTTCTTTAATCATTTTGCCTCTTTTCTCTGTGCTTCAATTAATAAAAAATGGAAAGAACCTCGAG | |
| Cas9 ORF with minimal uridine codons infrequently used in humans in general; 12.75% U | ATGGACAAAAAATACAGCATAGGGCTAGACAT-AGGGACGAACAGCGTAGGGTGGGCGGTAATAACGGACGAATACAAAGTACCGAGCAAAAAATTCAAAGTACTAGGGAACACGACCGACACAGCATAAAAAAAAAACCTAATAGGGGCGC-TACTATTCGACAGCGGGGAAACGGCGAAGCGACGCGACTAAAACGAACGGCGCGACGACGATACACGCGACGAAAAACCGAATATGCTACCTA-CAAGAAATATTCAGCAACGAAATGGCGAAGTAGACGACAGCTTCTTCCACCGACTAGAAGAAAGCTTCCTAGTAGAAGAA-GACAAAAACACGAACGACACCCGATATTCGGGAACATAGTAGACGAAGTAGCGTACCACGAAAAATACCCGACGATATACCACCTACGAAAAAACTAGTA-GACAGCACGGACAAAGCGGACCTACGACTAATATACCTAGCGCTAGCGCACATGATAAAAT-TCCGAGGGCACTTCCTAATAGAAGGGGACCTAAACCCGGACAACAGCGACGTAGACAAACTATTCATACAACTAGTACAAACGTACAACCAACTATTCGAAGAAAACCCGATAAACGCGAGCGGGGTA-GACGCGAAAGCGATACTAAGCGCGCGACTAAGCAAAAGCCGACGACTAGAAAACCTAATAGCGCAACTACCGGGGGAAAAAAAAACGGGCT-ATTCGGGAACCTAATAGCGCTAAGCCTAGGGCTAACGCCGAACTTCAAAAGCAACTTCGACCTAGCGGAAGACGCGAAACTACAACTAAGCAAA-GACACGTACGACGACCTAGACAACCTACTAGCGCAAATAGGGGACCAATACGCGGACCTATTCCTAGCGGCGAAAAACCTAAGCGACGC-GATACTACTAAGCGACATACTACGAGTAAACACGGAAATAACGAAAGCGCCGCTAAGCGCGAGCATGATAAAACGATACGACGAACACCACCAA-GACCTAACGCTACTAAAAGCGCTAGTACGACAACAACTACCGGAAAAATACAAAGAAATATTCTTCGAC-CAAAGCAAAACGGGTACGCGGGGTACATAGACGGGGGGCGAGCCAAGAAGAATTCTACAAATTCATAAAACCGATACTAGAAAAAATGGACGGGACGGAAGAAC-TACTAGTAAAACTAAACCGAGAAGACCTACTACGAAAACAACGAACGTTCGACAACGGGAGCATACCGCACCAAATACACCTAGGGGAACTACACGCGATAC-TACGACGACAAGAAGACTTCTACCCGTTCCTAAAAGACAACCGAGAAAAATAGAAAAATACTAACGTTCCGAATACCGTAC-TACGTAGGGCCGCTAGCGCGAGGGAACAGCCGATTCGCGTGGATGACGCGAAAAAGCGAAGAAACGATAACGCCGTGGAACTTCGAAGAAGTAGTA-GACAAAGGGGCGAGCGCGCAAAGCTTCATAGAACGAATGACG | 54 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| content | AACTTCGACAAAAACCTACCGAACGAAAAAGTACTACCGAAACACAGCCTAC-TATACGAATACTTCACGGTATACAACGAACTAACGAAAGTA AAATACGTAACGGAAGGGATGCGAAAACCGGCGTTCCTAAGCGGGGAACAAAAAAAGC-GATAGTAGACCTACTATTCAAAACGAACCGAAAA GTAACGGTAAAACAACTAAAAGAAGACTACTT-CAAAAAAATAGAATGCTTCGACAGCGTAGAAATAAGCGGGGTAGAAGACCGATTCAACGCG AGCCTAGGGACGTACCACGACCTACTAAAAATAATAAAAGACAAAGACTTCCTA-GACAACGAAGAAAACGAAGACATACTAGAAGACATAGTA CTAACGCTAACGCTATTCGAAGACCGAGAAATGA-TAGAAGAACGACTAAAAACGTACGCGCACCTATTCGACGACAAAGTAATGAAACAACTA AAACGACGACGATACACGGGGTGGGGGCGACTAAGCCGAAAACTAATAAACGGGATACGA-GACAAACAAAGCGGGAAAACGATACTAGACTTC CTAAAAAGCGACGGGTTCGCGAACCGAAACTTCATGCAACTAATA-CACGACGACAGCCTAACGTTCAAAGAAGACATACAAAAAGCGAAGTA AGCGGGCAAGGGGACAGCCTACACGAACACATAGCGAACCTAGCGGGGAGCCCGGCGA-TAAAAAAAGGGATACTACAAACGGTAAAAGTAGTA GACGAACTAGTAAAAGTAATGGGGCGACACAAACCGGAAAACAT-AGTAATAGAAATGGCGCGAGAAAACCAAACGACGCAAAAAGGGCAAAAA AACAGCCGAGAACGAATGAAACGAATAGAAGAAGGGATAAAAGAACTAGGGAGC-CAAATACTAAAAGAACACCCGGTAGAAAACACGCAACTA CAAAACGAAAAACTATACCTATACTACCTACAAAACGGGCGAGACATGTACGTAGAC-CAAGAACTAGACATAAACCGACTAAGCGACTACGAC GTAGACCACATAGTACCGCAAAGCTTCCTAAAAGACGACAGCATA-GACAACAAAGTACTAACGCGAAGCGACAAAAACCGAGGGAAAAGCGAC AACGTACCGAGCGAAGAAGTAGTAAAAAAAATGAAAAACTACTGGCGACAAC-TACTAAACGCGAAACTAATAACGCAACGAAAATTCGACAAC CTAACGAAAGCGGAACGAGGGGGGCTAAGCGAACTAGACAAAGCGGGGTTCAT-AAAACGACAACTAGTAGAAACGCGACAAATAACGAAACAC GTAGCGCAAATACTAGACAGCCGAAT-GAACACGAAATACGACGAAAACGACAAACTAATACGAGAAGTAAAAGTAATAACGCTAAAAGCAAA CTAGTAAGCGACTTCCGAAAAGACTTCCAATTCTACAAAGTACGAGAAATAAACAACTAC-CACCACGCGCACGACGCGTACCTAAACGCGGTA GTAGGGACGGCGCTAATAAAAAAATACCCGAAACTAGAAAGCGAATTCGTATACGGGGAC-TACAAAGTATACGACGTACGAAAAATGATAGCG AAAAGCGAACAAGAAATAGGGAAAGCGACGGCGAAATACTTCTTCTACAGCAACATAAT-GAACTTCTTCAAAACGGAAATAACGCTAGCGAAC GGGGAAATACGAAAACGACCGCTAATAGAAACGAACGGGGAAACGGGG-GAAATAGTATGGGACAAAGGGCGAGACTTCGCGACGGTACGAAAA GTACTAAGCATGCCGCAAGTAAACATAGTAAAAAAAACGGAAGTA-CAAACGGGGGGTTCAGCAAAGAAAGCATACTACCGAAACGAAACAGC GACAAACTAATAGCGCGAAAAAAA-GACTGGGACCCGAAAAAATACGGGGGGTTCGACAGCCCGACGGTAGCGTACAGCGTACTAGTAGTAGCG AAAGTAGAAAAAGGGAAAAGCAAAAAACTAAAAAGCGTAAAAGAACTACTAGGGATAAC-GATAATGGAACGAAGCAGCTTCGAAAAAAACCCG ATAGACTTCCTAGAAGCGAAAGGGTACAAAGAAGTAAAAAAAGACCTAATAATAAAAC-TACCGAAATACAGCCTATTCGAACTAGAAAACGGG CGAAAACGAATGCTAGCGAGCGCGGGGGAACTACAAAAAGGGAACGAACTAGCGC-TACCGAGCAAATACGTAAACTTCCTATACCTAGCGAGC CACTACGAAAAACTAAAAGGGAGCCCGGAAGACAACGAACAAAAACAACTAT-TCGTAGAACAACACAAACACTACCTAGACGAAATAATAGAA CAAATAAGCGAATTCAGCAAACGAGTAATACTAGCGGACGCGAACCTA-GACAAAGTACTAAGCGCGTACAACAAACACCGAGACAAACCGATA CGAGAACAAGCGGAAAACATAATACACCTATT-CACGCTAACGAACCTAGGGGCGCCGGCGGCGTTCAAATACTTCGACACGACGATAGACCGA AAACGATACACGAGCACGAAAGAAGTACTAGACGCGACGCTAATACACCAAAGCAT-AACGGGGCTATACGAAACGCGAATAGACCTAAGCCAA CTAGGGGGGGACGGGGGGGGGAGCCCGAAAAAAAAACGAAAAGTATGA | |
| Cas9 transcript with 5' UTR of HSD, ORF corres- | GGGTCCCGCAGTCGGCGTCCAGCGGCTCTGCTTGTTCGTGTGTGTCGTTGCAGGCCTT-ATTCGGATCCGCCACCATGGACAAAAAATACAG CATAGGGCTAGACATAGGGACGAACAGCGTAGGGTGGGCGGTAATAACGGACGAATA-CAAAGTACCGAGCAAAAAATTCAAAGTACTAGGGAA CACGGACCGACACAGCATAAAAAAAAACCTAATAGGGGCGCTACTATTCGACAGCGGG-GAAACGGCGGAAGCGACGCGACTAAAACGAACGGC GCGACGACGATACACGCGACGAAAAAACCGAATATGCTACCTACAAGAAATAT-TCAGCAACGAAATGGCGAAAGTAGACGACAGCTTCTTCCA CCGACTAGAAGAAAGCTTCCTAGTAGAAGAAGACAAAAAACACGAACGACACCCGATAT-TCGGGAACATAGTAGACGAAGTAGCGTACCACGA AAAATACCCGACGATATACCACCTACGAAAAAAACTAGTA-GACAGCACGGACAAAGCGGACCTACGACTAATATACCTAGCGCTAGCGCACAT GATAAAAT-TCCGAGGGCACTTCCTAATAGAAGGGGACCTAAACCCGGACAACAGCGACGTAGACAAACTATTCATACAACTAGTACAAACGTA CAACCAACTATTCGAAGAAAACCCGATAAACGCGAGCGGGGTAGACGCGAAAGCGA-TACTAAGCGCGCGACTAAGCAAAAGCCGACGACTAGA AAACCTAATAGCGCAACTACCGGGGGAAAAAAAAACGGGCTATTCGG-GAACCTAATAGCGCTAAGCCTAGGGCTAACGCCGAACTTCAAAAG | 55 |

-continued

Sequence Table
The following sequence table provides a listing of sequences disclosed herein. It is understood that if a DNA sequence (comprising Ts) is referenced with respect to an RNA, then Ts should be replaced with Us(which may be modified or unmodified depending on the context), and vice versa.

| Description | Sequence | SEQ ID No. |
|---|---|---|
| pond-ing to SEQ ID NO: 54, Kozak sequence, and 3' UTR of ALB | CAACTTCGACCTAGCGGAAGACGCGAAACTACAACTAAGCAAA-GACACGTACGACGACGACCTAGACAACCTACTAGCGCAAATAGGGGACCA ATACGCGGACCTATTCCTAGCGGCGAAAAACCTAAGCGACGCGATACTACTAAGCGACAT-ACTACGAGTAAACACGGAAATAACGAAAGCGCC GCTAAGCGCGAGCATGATAAAACGATACGACGAACACCACCAAGACCTAACGC-TACTAAAAGCGCTAGTACGACAACAACTACCGGAAAAATA CAAAGAAATATTCTTCGACCAAAGCAAAAACGGGTACGCGGGGTACATA-GACGGGGGGGCGAGCCAAGAAGAATTCTACAAATTCATAAAACC GATACTAGAAAAAATGGACGGGACGGAAGAACTACTAGTAAAACTAAACCGAGAAGACC-TACTACGAAAACAACGAACGTTCGACAACGGGAG CATACCGCACCCAAATACACCTAGGGGAACTACACGCGATACTACGACGACAAGAA-GACTTCTACCCGTTCCTAAAAGACAACCGAGAAAAAT AGAAAAAATACTAACGTTCCGAATACCGTACTACGTAGGGCCGCTAGCGCGAGG-GAACAGCCGATTCGCGTGGATGACGCGAAAAAGCGAAGA AACGATAACGCCGTGGAACTTCGAAGAAGTAGTAGACAAAGGGGCGAGCGCGCAAAGCTT-CATAGAACGAATGACGAACTTCGACAAAAACCT ACCGAACGAAAAAGTACTACCGAAACACAGCCTACTATACGAATACTTCACGGTATA-CAACGAACTAACGAAAGTAAAATACGTAACGGAAGG GATGCGAAAACCGGCGTTCCTAAGCGGGGAACAAAAAAAAGCGATAGTAGACCTACTATT-CAAAACGAACCGAAAAGTAACGGTAAAACAACT AAAAGAAGACTACTT-CAAAAAAATAGAATGCTTCGACAGCGTAGAAATAAGCGGGGTAGAAGACCGATTCAACGCGAGCCTAGGGACGTACCA CGACCTACTAAAAATAATAAAAGACAAAGACTTCCTAGACAACGAAGAAAACGAAGACAT-ACTAGAAGACATAGTACTAACGCTAACGCTATT CGAAGACCGAGAAATGATAGAAGAACGACTAAAAACGTACGCGCACCTAT-TCGACGACAAAGTAATGAAACAACTAAAACGACGACGATACAC GGGGTGGGGCGACTAAGCCGAAAACTAATAAACGGGATACGAGACAAACAAAGCGG-GAAAACGATACTAGACTTCCTAAAAAGCGACGGGTT CGCGAACCGAAACTTCATGCAACTAATACACGACGACAGCCTAACGTTCAAAGAAGA-CATACAAAAAGCGCAAGTAAGCGGGCAAGGGGACAG CCTACACGAACACATAGCGAACCTAGCGGGGAGCCCGGCGATAAAAAAAGGGATACTA-CAAACGGTAAAGTAGTAGACGAACTAGTAAAAGT AATGGGGCGACACAAACCGGAAAACATAGTAATAGAAATGGCGCGAGAAAAC-CAAACGACGCAAAAAGGGCAAAAAAACAGCCGAGAACGAAT GAAACGAATAGAAGAAGGGATAAAAGAACTAGGGAGC-CAAATACTAAAAGAACACCCGGTAGAAAACACGCAACTACAAAACGAAAACTATA CCTATACTACCTACAAAACGGGCGAGACATGTACGTAGACCAAGAACTAGACAT-AAACCGACTAAGCGACTACGACGTAGACCACATAGTACC GCAAAGCTTCCTAAAAGACGACAGCATA-GACAACAAAGTACTAACGCGAAGCGACAAAAACCGAGGGAAAAGCGACAACGTACCGAGCGAAGA AGTAGTAAAAAAAATGAAAAACTACTGGCGACAAC-TACTAAACGCGAAACTAATAACGCAACGAAAATTCGACAACCTAACGAAAGCGGAACG AGGGGGGGCTAAGCGAACTAGACAAAGCGGGGTTCAT-AAAACGACAACTAGTAGAAACGCGACAAATAACGAAACACGTAGCGCAAATACTAGA CAGCCGAAT-GAACACGAAATACGACGAAAACGACAAACTAATACGAGAAGTAAAAGTAATAACGCTAAAAAGCAAACTAGTAAGCGACTTCCG AAAAGACTTCCAATTCTACAAAGTACGAGAAATAAACAACTACCAC-CACGCGCACGACGCGTACCTAAACGCGGTAGTAGGGACGGCGCTAAT AAAAAAATACCCGAAACTAGAAAGCGAATTCGTATACGGGGACTA-CAAAGTATACGACGTACGAAAATGATAGCGAAAAGCGAACAAGAAT AGGGAAAGCGACGGCGAAATACTTCTTCTACAGCAACATAATGAACTTCTTCAAAACG-GAAATAACGCTAGCGAACGGGGAAATACGAAAACG ACCGCTAATAGAAACGAACGGGGAAACGGGGGAAATAGTATGGGACAAAGGGCGA-GACTTCGCGACGGTACGAAAAGTACTAAGCATGCCGCA AGTAAACATAGTAAAAAAAACGGAAGTACAAACGGGGGGGTTCAGCAAAGAAAGCATAC-TACCGAAACGAAACAGCGACAAACTAATAGCGCG AAAAAAAGACTGGGACCCGAAAAAATACGGGGGGTTCGACAGCCCGACGGTAGCGTA-CAGCGTACTAGTAGTAGCGAAAGTAGAAAAAGGGAA AAGCAAAAAACTAAAAAGCGTAAAAGAACTACTAGGGATAACGATAATG-GAACGAAGCAGCTTCGAAAAAAACCCGATAGACTTCCTAGAAGC GAAAGGGTACAAAGAAGTAAAAAAAGACCTAATAATAAAACTACCGAAATACAGCCTAT-TCGAACTAGAAAACGGGCGAAAACGAATGCTAGC GAGCGCGGGGGAACTACAAAAAGGGAACGAACTAGCGC-TACCGAGCAAATACGTAAACTTCCTATACCTAGCGAGCCACTACGAAAACTAAA AGGGAGCCCGGAAGACAACGAACAAAAACAACTATTCGTAGAACAACACAAACAC-TACCTAGACGAAATAATAGAACAAATAAGCGAATTCAG CAAACGAGTAATACTAGCGGACGCGAACCTAGACAAAGTACTAAGCGCGTA-CAACAAACACCGAGACAAACCGATACGAGAACAAGCGGAAAA CATAATACACCTATTCACGCTAACGAACCTAGGGGCGCCGGCGGCGTT-CAAATACTTCGACACGACGATAGACCGAAAACGATACACGAGCAC GAAAGAAGTACTAGACGCGACGCTAATACACCAAAGCATAACGGGGC-TATACGAAACGCGAATAGACCTAAGCCAACTAGGGGGGACGGGGG GGGGAGCCCGAAAAAAAAACGAAAAGTATGACTAGCCATCACATT-TAAAAGCATCTCAGCCTACCATGAGAATAAGAGAAAGAAAATGAAGAT | |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | CAATAGCTTATTCATCTCTTTTTCTTTTTCGTTGGTGTAAAGC-CAACACCCTGTCTAAAAAACATAAATTTCTTTAATCATTTTGCCTCTTTTCTCTGTGCTTCAATTAATAAAAAATGGAAAGAACCTCGAG | |
| Cas9 transcript with AGG as first three nucleotides for use with CleanCap™, 5' UTR of HSD, ORF corresponding to SEQ ID NO: 4, Kozak sequence, and 3' UTR of ALB | AGGTCCCGCAGTCGGCGTCCAGCGGCTCTGCTTGTTCGTGTGTGTCGTTGCAGGCCTT-ATTCGGATCCGCCACCATGGACAAGAAGTACAG<br>CATCGGACTGGACATCGGAACAAACAGCGTCGGATGGGCAGTCATCACAGACGAATA-CAAGGTCCCGAGCAAGAAGTTCAAGGTCCTGGGAAA<br>CACAGACAGACACAGCATCAAGAAGAACCTGATCGGAGCACTGCTGTTCGACAGCG-GAGAAACAGCAGAAGCAACAAGACTGAAGAGAACAGC<br>AAGAAGAAGATACACAAGAAGAAAGAACAGAATCTGCTACCTGCAG-GAAATCTTCAGCAACGAAATGGCAAAGGTCGACGACAGCTTCTTCCA<br>CAGACTGGAAGAAAGCTTCCTGGTCGAAGAAGACAAGAAGCACGAAAGACACCC-GATCTTCGGAAACATCGTCGACGAAGTCGCATACCACGA<br>AAAGTACCCGACAATCTACCACCTGAGAAAGAAGCTGGTCGACAGCACAGACAAGGCA-GACCTGAGACTGATCTACCTGGCACTGGCACACAT<br>GATCAAGTTCAGAGGACACTTCCTGATCGAAGGAGACCT-GAACCCGGACAACAGCGACGTCGACAAGCTGTTCATCCAGCTGGTCCAGACATA<br>CAACCAGCTGTTCGAAGAAAACCCGATCAACGCAAGCGGAGTCGACGCAAAGGCAATCCT-GAGCGCAAGACTGAGCAAGAGCAGAAGACTGGA<br>AAACCTGATCGCACAGCTGCCGGGAGAAAAGAAGAACGGACTGTTCGGAAACCT-GATCGCACTGAGCCTGGGACTGACACCGAACTTCAAGAG<br>CAACTTCGACCTGGCAGAAGACGCAAAGCTGCAGCTGAGCAAGGACACAT-ACGACGACGACCTGGACAACCTGCTGGCACAGATCGGAGACCA<br>GTACGCAGACCTGTTCCTGGCAGCAAAGAACCTGAGCGACGCAATCCTGCTGAGCGA-CATCCTGAGAGTCAACACAGAAATCACAAAGGCACC<br>GCTGAGCGCAAGCATGATCAAGAGATACGACGAACACCACCAGGACCTGACACTGCT-GAAGGCACTGGTCAGACAGCAGCTGCCGGAAAAGTA<br>CAAGGAAATCTTCTTCGACCAGAGCAAGAACGGATACGCAGGATACATCGACGGAG-GAGCAAGCCAGGAAGAATTCTACAAGTTCATCAAGCC<br>GATCCTGGAAAAGATGGACGGAACAGAAGAACTGCTGGTCAAGCTGAACAGAGAA-GACCTGCTGAGAAAGCAGAGAACATTCGACAACGGAAG<br>CATCCCGCACCAGATCCACCTGGGAGAACTGCACGCAATCCTGAGAAGACAGGAA-GACTTCTACCCGTTCCTGAAGGACAACAGAGAAAAGAT<br>CGAAAAGATCCTGACATTCAGAATCCCGTACTACGTCGGACCGCTGGCAAGAG-GAAACAGCAGATTCGCATGGATGACAAGAAAGAGCGAAGA<br>AACAATCACACCGTGGAACTTCGAAGAAGTCGTCGACAAGGGAGCAAGCGCACAGAGCTT-CATCGAAAGAATGACAAACTTCGACAAGAACCT<br>GCCGAACGAAAAGGTCCTGCCGAAGCACAGCCTGCTGTACGAATACTTCACAGTCTA-CAACGAACTGACAAAGGTCAAGTACGTCACAGAAGG<br>AATGAGAAAGCCGGCATTCCTGAGCGGAGAACAGAAGAAGGCAATCGTCGACCTGCTGTT-CAAGACAAACAGAAAGGTCACAGTCAAGCAGCT<br>GAAGGAAGACTACTTCAAGAAGATCGAATGCTTCGACAGCGTCGAAATCAGCG-GAGTCGAAGACAGATTCAACGCAAGCCTGGGAACATACCA<br>CGACCTGCTGAAGATCATCAAGGACAAGGACTTCCTGGACAACGAAGAAAACGAAGA-CATCCTGGAAGACATCGTCCTGACACTGACACTGTT<br>CGAAGACAGAGAAATGATCGAAGAAAGACTGAAGACAT-ACGCACACCTGTTCGACGACAAGGTCATGAAGCAGCTGAAGAGAAGAAGATACAC<br>AGGATGGGGAAGACTGAGCAGAAAGCTGATCAACGGAATCAGAGACAAGCAGAGCGGAAA-GACAATCCTGGACTTCCTGAAGAGCGACGGATT<br>CGCAAACAGAAACTTCATGCAGCTGATCCACGACGACAGCCTGACATTCAAGGAAGA-CATCCAGAAGGCACAGGTCAGCGGACAGGGAGACAG<br>CCTGCACGAACACATCGCAAACCTGGCAGGAAGCCCGGCAATCAAGAAGGGAATCCTGCA-GACAGTCAAGGTCGTCGACGAACTGGTCAAGGT<br>CATGGGAAGACACAAGCCGGAAAACATCGTCATCGAAATGGCAAGAGAAAACCA-GACAACACAGAGGGACAGAAGAACAGCAGAGAAAGAAT<br>GAAGAGAATCGAAGAAGGAATCAAGGAACTGGGAAGCCAGATCCT-GAAGGAACACCCGGTCGAAAACACACAGCTGCAGAACGAAAAGCTGTA<br>CCTGTACTACCTGCAGAACGGAAGAGACATGTACGTCGACCAGGAACTGGACATCAACA-GACTGAGCGACTACGACGTCGACCACATCGTCCC<br>GCAGAGCTTCCTGAAGGACGACAG-CATCGACAACAAGGTCCTGACAAGAAGCGACAAGAACAGAGGAAAGAGCGACAACGTCCCGAGCGAAGA<br>AGTCGTCAAGAAGATGAAGAACTACTGGAGACAGCTGCTGAACGCAAAGCTGAT-CACACAGAGAAAGTTCGACAACCTGACAAAGGCAGAGAG<br>AGGAGGACTGAGCGAACTGGACAAGGCAGGATTCATCAAGAGACAGCTGGTCGAAACAA-GACAGATCACAAAGCACGTCGCACAGATCCTGGA<br>CAGCAGAATGAACACAAAGTACGACGAAAACGACAAGCTGATCAGAGAAGTCAAGGTCAT-CACACTGAAGAGCAAGCTGGTCAGCGACTTCAG<br>AAAGGACTTCCAGTTCTACAAGGTCAGAGAAATCAACAACTACCACCACGCACACGACG-CATACCTGAACGCAGTCGTCGGAACAGCACTGAT<br>CAAGAAGTACCCGAAGCTGGAAAGCGAATTCGTCTACGGAGACTACAAGGTC-TACGACGTCAGAAAGATGATCGCAAAGAGCGAACAGGAAAT<br>CGGAAAGGCAACAGCAAAGTACTTCTTCTACAGCAACATCATGAACTTCTTCAA-GACAGAAATCACACTGGCAAACGGAGAAATCAGAAAGAG<br>ACCGCTGATCGAAACAAACGGAGAAACAGGAGAAATCGTCTGGGACAAGGGAAGA-GACTTCGCAACAGTCAGAAAGGTCCTGAGCATGCCGCA | 56 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | GGTCAACATCGTCAAGAAGACAGAAGTCCAGACAGGAGGAT-<br>TCAGCAAGGAAAGCATCCTGCCGAAGAGAAACAGCGACAAGCTGATCGCAAG<br>AAAGAAGGACTGGGACCCGAAGAAGTACGGAGGATTCGACAGCCCGACAGTCGCATA-<br>CAGCGTCCTGGTCGTCGCAAAGGTCGAAAAGGGAAA<br>GAGCAAGAAGCTGAAGAGCGTCAAGGAACTGCTGGGAATCACAATCATG-<br>GAAAGAAGCAGCTTCGAAAAGAACCCGATCGACTTCCTGGAAGC<br>AAAGGGATACAAGGAAGTCAAGAAGGACCTGATCATCAAGCTGCCGAAGTA-<br>CAGCCTGTTCGAACTGGAAAACGGAAGAAAGAGAATGCTGGC<br>AAGCGCAGGAGAACTGCAGAAGGGAAACGAACTGGCACTGCCGAGCAAGTACGT-<br>CAACTTCCTGTACCTGGCAAGCCACTACGAAAAGCTGAA<br>GGGAAGCCCGGAAGACAACGAACAGAAGCAGCTGTTCGTCGAACAGCACAAGCAC-<br>TACCTGGACGAAATCATCGAACAGATCAGCGAATTCAG<br>CAAGAGAGTCATCCTGGCAGACGCAAACCTGGACAAGGTCCTGAGCGCATA-<br>CAACAAGCACAGAGACAAGCCGATCGAGAACAGGCAGAAAA<br>CATCATCCACCTGTTCACACTGACAAACCTGGGAGCACCGGCAGCATT-<br>CAAGTACTTCGACACAACAATCGACAGAAAGAGATACACAAGCAC<br>AAAGGAAGTCCTGGACGCAACACTGATCCACCAGAGCAT-<br>CACAGGACTGTACGAAACAAGAATCGACCTGAGCCAGCTGGGAGGAGACGGAGG<br>AGGAAGCCCGAAGAAGAAGAGAAAGGTCTAGCTAGCCATCACATT-<br>TAAAAGCATCTCAGCCTACCATGAGAATAAGAGAAAGAAAATGAAGAT<br>CAATAGCTTATTCATCTCTTTTTCTTTTTCGTTGGTGTAAAGC-<br>CAACACCCTGTCTAAAAAACATAAATTTCTTTAATCATTTTGCCTCTTTT<br>CTCTGTGCTTCAATTAATAAAAAATGGAAAGAACCTCGAG | |
| Cas9 transcript with 5' UTR from CMV, ORF corresponding to SEQ ID NO: 4, Kozak sequence, and 3' UTR of ALB | GGGCAGATCGCCTGGAGACGCCATCCACGCTGTTTTGACCTCCATAGAA-<br>GACACCGGGACCGATCCAGCCTCCGCGGCCGGGAACGGTGCATT<br>GGAACGCGGATTCCCCGTGCCAAGAGTGACTCACCGTCCTTGACACGGCCAC-<br>CATGGACAAGAAGTACAGCATCGGACTGGACATCGGAACAA<br>ACAGCGTCGGATGGGCAGTCATCACAGACGAATACAAGGTCCCGAGCAAGAAGTT-<br>CAAGGTCCTGGGAAACACAGACAGACACAGCATCAAGA<br>AGAACCTGATCGGAGCACTGCTGTTCGACAGCGGAGAAACAGCAGAAGCAACAAGACT-<br>GAAGAGAACAGCAAGAAGAAGATACACAAGAAGAA<br>AGAACAGAATCTGCTACCTGCAG-<br>GAAATCTTCAGCAACGAAATGGCAAAGGTCGACGACAGCTTCTTCCACAGACTGGAAGAAAGCTTCCTGG<br>TCGAAGAAGACAAGAAGCACGAAAGACACCCGATCTTCGGAAACATCGTCGACGAAGTCG-<br>CATACCACGAAAAGTACCCGACAATCTACCACC<br>TGAGAAAGAAGCTGGTCGACAGCACAGACAAGGCAGACCTGAGACTGATC-<br>TACCTGGCACTGGCACACATGATCAAGTTCAGAGGACACTTCC<br>TGATCGAAGGAGACCTGAACCCGGACAACAGCGACGTCGACAAGCTGTT-<br>CATCCAGCTGGTCCAGACATACAACCAGCTGTTCGAAGAAAACC<br>CGATCAACGCAAGCGGAGTCGACGCAAAGGCAATCCTGAGCGCAAGACT-<br>GAGCAAGAGCAGAAGACTGGAAAACCTGATCGCACAGCTGCCGG<br>GAGAAAAGAAGAACGGACTGTTCGGAAACCTGATCGCACT-<br>GAGCCTGGGACTGACACCGAACTTCAAGAGCAACTTCGACCTGGCAGAAGACG<br>CAAAGCTGCAGCTGAGCAAGGACACATACGACGACGACCTGGACAACCTGCTGGCACA-<br>GATCGGAGACCAGTACGCAGACCTGTTCCTGGCAG<br>CAAAGAACCTGAGCGACGCAATCCTGCTGAGCGACATCCTGAGAGTCAACACAGAAAT-<br>CACAAAGGCACCGCTGAGCGCAAGCATGATCAAGA<br>GATACGACGAACACCACCAGGACCTGACACTGCTGAAGGCACTGGTCA-<br>GACAGCAGCTGCCGGAAAAGTACAAGGAAATCTTCTTCGACCAGA<br>GCAAGAACGGATACGCAGGATACATCGACGGAGGAGCAAGCCAGGAAGAATTCTA-<br>CAAGTTCATCAAGCCGATCCTGGAAAAGATGGACGGAA<br>CAGAAGAACTGCTGGTCAAGCTGAACAGAGAAGACCTGCTGAGAAAGCAGAGAACAT-<br>CGACAACGGAAGCATCCCGCACCAGATCCACCTGG<br>GAGAACTGCACGCAATCCTGAGAAGACAGGAAGACTTCTACCCGTTCCT-<br>GAAGGACAACAGAGAAAAGATCGAAAAGATCCTGACATTCAGAA<br>TCCCGTACTACGTCGGACCGCTGGCAAGAGGAAACAGCAGATTCGCATG-<br>GATGACAAGAAAGAGCGAAGAAACAATCACACCGTGGAACTTCG<br>AAGAAGTCGTCGACAAGGGAGCAAGCGCACAGAGCTT-<br>CATCGAAAGAATGACAAACTTCGACAAGAACCTGCCGAACGAAAGGTCCTGCCGA<br>AGCACAGCCTGCTGTATGAATACTTCACAGTCTACAACGAACTGACAAAGGT-<br>CAAGTACGTCACAGAAGGAATGAGAAAGCCGGCATTCCTGA<br>GCGGAGAACAGAAGAAGGCAATCGTCGACCTGCTGTTCAAGACAAACAGAAAGGT-<br>CACAGTCAAGCAGCTGAAGGAAGACTACTTCAAGAAGA<br>TCGAATGCTTCGACAGCGTCGAAATCAGCGGAGTCGAAGACAGATTCAACGCAAGCCTGG-<br>GAACATACCACGACCTGCTGAAGATCATCAAGG<br>ACAAGGACTTCCTGGACAACGAAGAAAACGAAGACATCCTGGAAGA-<br>CATCGTCCTGACACTGACACTGTTCGAAGACAGAGAAATGATCGAAG<br>AAAGACTGAAGACATACGCACACCTGTTCGACGACAAGGTCATGAAGCAGCT-<br>GAAGAGAAGAAGATACACAGGATGGGGAAGACTGAGCAGAA<br>AGCTGATCAACGGAATCAGAGACAAGCAGAGCGGAAAGACAATCCTGGACTTCCT-<br>GAAGAGCGACGGATTCGCAAACAGAAACTTCATGCAGC<br>TGATCCACGACGACAGCCTGACATTCAAGGAAGA-<br>CATCCAGAAGGCACAGGTCAGCGGACAGGGAGACAGCCTGCACGAACACATCGCAAACC<br>TGGCAGGAAGCCCGGCAATCAAGAAGGGAATCCTGCAGACAGT-<br>CAAGGTCGTCGACGAACTGGTCAAGGTCATGGGAAGACACAAGCCGGAAA | 57 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | ACATCGTCATCGAAATGGCAAGAGAAAACCA-GACAACACAGAAGGGACAGAAGAACAGCAGAGAAAGAATGAAGAGAATCGAAGAAGGAATCAAGGAACTGGGAAGCCAGATCCT-GAAGGAACACCCGGTCGAAAACACACAGCTGCAGAACGAAAAGCTGTACCTGTACTACCTGCAGAACGGAAGAGACATGTACGTCGACCAGGAACTGGACATCAACGACTGAGCGACTACGACGTCGAC-CACATCGTCCCGCAGAGCTTCCTGAAGGACGACAGCATCGACAACAAGGTCCTGACAAGAAGCGACAAGAACAGAG-GAAAGAGCGACAACGTCCCGAGCGAAGAAGTCGTCAAGAAGATGAAGAACTACTGGAGACAGCTGCTGAACGCAAAGCTGAT-CACACAGAGAAAGTTCGACAACCTGACAAAGGCAGAGAGAGGAGGACTGAGCGAACTGGACAAGGCAGGATTCATCAAGAGACAGCTGGTCGAAACAAGACAGAT-CACAAAGCACGTCGCACAGATCCTGGACAGCAGAATGAACACAAAGTACGACGAAAACGACAAGCTGATCAGAGAAGTCAAGGTCATCACACT-GAAGAGCAAGCTGGTCAGCGACTTCAGAAAGGACTTCCAGTTCTACAAGGTCAGAGAAATCAACAACTACCACCACGCACACGACGCATACCTGAACGCAGTCGTCG-GAACAGCACTGATCAAGAAGTACCCGAAGCTGGAAAGCGAATTCGTCTACGGAGACTACAAGGTCTACGACGTCAGAAAGAT-GATCGCAAAGAGCGAACAGGAAATCGGAAAGGCAACAGCAAAGTACTTCTTCTACAGCAACATCATGAACTTCTTCAAGACAGAAATCACACTGGCAAACG-GAGAAATCAGAAAGAGACCGCTGATCGAAACAAACGGAGAAACAGGAGAAATCGTCTGGGACAAGGGAAGAGACTTCGCAACAGTCAGAAAGGTCCT-GAGCATGCCGCAGGTCAACATCGTCAAGAAGACAGAAGTCCAGACAGGAGGAT-TCAGCAAGGAAAGCATCCTGCCGAAGAGAAACAGCGACAAGCTGATCGCAAGAAAGAAGGACTGGGACCCGAAGAAGTACGGAGGATTCGACAGCCCGACAGTCGCATA-CAGCGTCCTGGTCGTCGCAAAGGTCGAAAAGGGAAAGAGCAAGAAGCTGAAGAGCGTCAAGGAACTGCTGGGAATCACAATCATGGAAAGAAGCAGCTTCGAAAAGAACCC-GATCGACTTCCTGGAAGCAAAGGGATACAAGGAAGTCAAGAAGGACCTGATCATCAAGCTGCCGAAGTACAGCCTGTTCGAACTGGAAAACG-GAAGAAAGAGAATGCTGGCAAGCGCAGGAGAACTGCAGAAGGGAAACGAACTGGCACTGCCGAGCAAGTACGTCAACTTCCTGTACCTGGCAAGCCAC-TACGAAAAGCTGAAGGGAAGCCCGGAAGACAACGAACAGAAGCAGCTGTTCGTCGAACAGCACAAGCACTACCTGGACGAAATCATCGAACA-GATCAGCGAATTCAGCAAGAGAGTCATCCTGGCAGACGCAAACCTGGACAAGGTCCTGAGCGCATACAACAAGCACAGAGACAAGCC-GATCAGAGAACAGGCAGAAAACATCATCCACCTGTTCACACTGACAAACCTGGGAGCACCGGCAGCATTCAAGTACTTCGACACAACAATCGACAGAAAGAGA-TACAAGCACAAAGGAAGTCCTGGACGCAACACTGATCCACCAGAGCATCACAGGACTGTACGAAACAAGAATCGACCTGAGCCAGCTGGGAG-GAGACGAGGAGGAAGCCCGAAGAAGAAGAGAAAGGTCTAGCTAGCCATCACATTTAAAAGCATCTCAGCCTACCAT-GAGAATAAGAGAAAGAAATGAAGATCAATAGCTTATTCATCTCTTTTTCTTTTTCGTTGGTGTAAAGCCAACACCCTGTCTAAAAAACATAAATTTCTTTAATCAT-TTTGCCTCTTTTCTCTGTGCTTCAATTAATAAAAATGGAAAGAACCTCGAG | |
| Cas9 transcript with 5' UTR from HBB, ORF corresponding to SEQ ID NO: 4, Kozak se- | GGGacatttgcttctgacacaactgtgttcactagcaacctcaaacagacaccg-gatctgccaccATGGACAAGAAGTACAGCATCGGACTGGACATCGGAAACAAACAGCGTCGGATGGGCAGTCATCACAGACGAATA-CAAGGTCCCGAGCAAGAAGTTCAAGGTCCTGGGAAACACAGACAGACACAGCATCAAGAAGAACCTGATCGGACACTGCTGTTCGACAGCG-GAGAAACAGCAGAAGCAACAAGACTGAAGAGAACAGCAAGAAGAAGATACACAAGAAGAAAGAACAGAATCTGCTACCTGCAG-GAAATCTTCAGCAACGAAATGGCAAAGGTCGACGACAGCTTCTTCCACAGACTGGAAGAAAGCTTCCTGGTCGAAGAAGACAAGAAGCACGAAAGACACCCGATCTTCGGAAA-CATCGTCGACGAAGTCGCATACCACGAAAAGTACCCGACAATCTACCACCTGAGAAAGAAGCTGGTCGACAGCACAGACAAGGCAGACCTGAGACT-GATCTACCTGGCACTGGCACACATGATCAAGTTCAGAGGGACACTTCCTGATCGAAGGAGACCT-GAACCCGGACAACAGCGACGTCGACAAGCTGTTCATCCAGCTGGTCCAGACATACAACCAGCTGTTCGAAGAAAACCCGATCAACGCAAGCGGAGTCGACGCAAAGGCAATCCTGAGCGCAA-GACTGAGCAAGAGCAGAAGACTGGAAAACCTGATCGCACAGCTGCCGGGAGAAAAGAAGAACGGACTGTTCGGAAACCTGATCGCACT-GAGCCTGGGACTGACACCGAACTTCAAGAGCAACTTCGACCTGGCAGAAGACGCAAAGCTGCAGCTGAGCAAGGACACAT-ACGACGACGACCTGGACAACCTGCTGGCACAGATCGGAGACCAGTACGCAGACCTGTTCCTGGCAGCAAAGAACCTGAGCGACGCAATCCTGCTGAGCGACATCCTGAGAGT-CAACACAGAAATCACAAAGGCACCGCTGAGCGCAAGCATGATCAAGAGATACGACGAACACCACCAGGACCTGACACTGCTGAAGGCACTGGTCA-GACAGCAGCTGCCGGAAAAGTACAAGGAAATCTTCTTCGACCAGAGCAAGAACGGATACGCAGGATACATCGACGGAGGAGCAAGCCAG-GAAGAATTCTACAAGTTCATCAAGCCGATCCTGGAAAAGATGGACGGAACAGAAGAACTGCTGGTCAAGCTGAACAGAGAAGACCTGCT-GAGAAAGCAGAGAACATTCGACAACGGAAGCATCCCGCACCAGATCCACCTGGGAGAACTGCACGCAATCCTGAGAAGACAGGAAGACTTC-TACCCGTTCCTGAAGGACAACAGAGAAAAGATCGAAAAGATCC | 58 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| quence, and 3' UTR of HBB | TGACATTCAGAATCCCGTACTACGTCGGACCGCTGGCAAGAGGAAACAGCAGATTCG-CATGGATGACAAGAAAGAGCGAAGAAACAATCACAC<br>CGTGGAACTTCGAAGAAGTCGTCGACAAGGGAGCAAGCGCACAGAGCTT-CATCGAAAGAATGACAAACTTCGACAAGAACCTGCCGAACGAAA<br>AGGTCCTGCCGAAGCACAGCCTGCTGTACGAATACTTCACAGTCTA-CAACGAACTGACAAAGGTCAAGTACGTCACAGAAGGAATGAGAAAGC<br>CGGCATTCCTGAGCGGAGAACAGAAGAAGGCAATCGTCGACCTGCTGTTCAA-GACAAACAGAAAGGTCACAGTCAAGCAGCTGAAGGAAGACT<br>ACTTCAAGAAGATCGAATGCTTCGACAGCGTCGAAATCAGCGGAGTCGAAGACAGATT-CAACGCAAGCCTGGGAACATACCACGACCTGCTGA<br>AGATCATCAAGGACAAGGACTTCCTGGACAACGAAGAAAACGAAGACATCCTGGAAGA-CATCGTCCTGACACTGACACTGTTCGAAGACAGAG<br>AAATGATCGAAGAAAGACTGAAGACATACGCACACCTGTTCGACGACAAGGTCAT-GAAGCAGCTGAAGAGGAAGAAGATACAGGATGGGGAA<br>GACTGAGCAGAAAGCTGATCAACGGAATCAGAGACAAGCAGAGCGGAAA-GACAATCCTGGACTTCCTGAAGAGCGACGGATTCGCAAACAGAA<br>ACTTCATGCAGCTGATCCACGACGACAGCCTGACATTCAAGGAAGA-CATCCAGAAGGCACAGGTCAGCGGACAGGGAGACAGCCTGCACGAAC<br>ACATCGCAAACCTGGCAGGAAGCCCGGCAATCAAGAAGGGAATCCTGCAGACAGT-CAAGGTCGTCGACGAACTGGTCAAGGTCATGGGAAGAC<br>ACAAGCCGGAAAACATCGTCATCGAAATGGCAAGAGAAAACCA-GACAACACAGAAGGGACAGAAGAACAGCAGAGAAAGAATGAAGAGAATCG<br>AAGAAGGAATCAAGGAACTGGGAAGCCAGATCCT-GAAGGAACACCCGGTCGAAAACACACAGCTGCAGAACGAAAAGCTGTACCTGTACTACC<br>TGCAGAACGGAAGAGACATGTACGTCGACCAGGAACTGGACATCAACAGACTGAGCGAC-TACGACGTCGACCACATCGTCCCGCAGAGCTTCC<br>TGAAGGACGACAGCATCGACAACAAGGTCCTGACAAGAAGCGACAAGAACAGAG-GAAAGAGCGACAACGTCCCGAGCGAAGAAGTCGTCAAGA<br>AGATGAAGAACTACTGGAGACAGCTGCTGAACGCAAAGCTGAT-CACACAGAGAAAGTTCGACAACCTGACAAAGGCAGAGAGAGGAGGACTGA<br>GCGAACTGGACAAGGCAGGATTCATCAAGAGACAGCTGGTCGAAACAAGACAGAT-CACAAAGCACGTCGCACAGATCCTGGACAGCAGAATGA<br>ACACAAAGTACGACGAAAACGACAAGCTGATCAGAGAAGTCAAGGTCATCACACT-GAAGAGCAAGCTGGTCAGCGACTTCAGAAAGGACTTCC<br>AGTTCTACAAGGTCAGAGAAATCAACAACTACCACCACGCACACGACGCATACCT-GAACGCAGTCGTCGGAACAGCACTGATCAAGAAGTACC<br>CGAAGCTGGAAAGCGAATTCGTCTACGGAGACTACAAGGTCTACGACGTCAGAAAGAT-GATCGCAAAGAGCGAACAGGAAATCGGAAAGGCAA<br>CAGCAAAGTACTTCTTCTACAGCAACATCATGAACTTCTTCAAGACAGAAAT-CACACTGGCAAACGGAGAAATCAGAAAGAGACCGCTGATCG<br>AAACAAACGGAGAAACAGGAGAAATCGTCTGGGACAAGGGAAGA-GACTTCGCAACAGTCAGAAAGGTCCTGAGCATGCCGCAGGTCAACATCG<br>TCAAGAAGACAGAAGTCCGACAGGAGGAT-TCAGCAAGGAAAGCATCCTGCCGAAGAGAAACAGCGACAAGCTGATCGCAAGAAAGAAGGACT<br>GGGACCCGAAGAAGTACGGAGGATTCGACAGCCCGACAGTCGCATA-CAGCGTCCTGGTCGTCGCAAAGGTCGAAAAGGGAAAGAGCAAGAAGC<br>TGAAGAGCGTCAAGGAACTGCTGGGAATCACAATCATG-GAAAGAAGCAGCTTCGAAAAGAACCCGATCGACTTCCTGGAAGCAAAGGGATACA<br>AGGAAGTCAAGAAGGACCTGATCATCAAGCTGCCGAAGTACAGCCTGTTCGAACTG-GAAAACGGAAGAAAGAGAATGCTGGCAAGCGCAGGAG<br>AACTGCAGAAGGGAAACGAACTGGCACTGCCGAGCAAGTACGT-CAACTTCCTGTACCTGGCAAGCCACTACGAAAAGCTGAAGGGAAGCCCGG<br>AAGACAACGAACAGAAGCAGCTGTTCGTCGAACAGCACAAGCACTACCTGGACGAAAT-CATCGAACAGATCAGCGAATTCAGCAAGAGAGTCA<br>TCCTGGCAGACGCAAACCTGGACAAGGTCCTGAGCGCATACAACAAGCACAGA-GACAAGCCGATCAGAGAACAGGCAGAAAACATCATCCACC<br>TGTTCACACTGACAAACCTGGGAGCACCGGCAGCATT-CAAGTACTTCGACACAACAATCGACAGAAAGAGATACACAAGCACAAAGGAAGTCC<br>TGGACGCAACACTGATCCACCAGAGCATCACAGGACTGTACGAAACAAGAATCGACCT-GAGCCAGCTGGGAGGAGACGGAGGAGGAAGCCCGA<br>AGAAGAGAGAAAGGTCTAGctagcgctcgctttcttgctgtccaatttctat-taaaggttccttttgttccctaagtccaactactaaactgg<br>gggatattatgaagggccttgagcatctggattctgcctaataaaaaacatttattttcattgcctcgag | |
| Cas9 transcript with 5' UTR from | GGGaagctcagaataaacgctcaactttggccggatctgccacCATGGACAAGAAGTA-CAGCATCGGACTGGACATCGGAACAAACAGCGTCG<br>GATGGGCAGTCATCACAGACGAATACAAGGTCCCGAGCAAGAAGTTCAAGGTCCTGG-GAAACACAGACAGACACAGCATCAAGAAGAACCTGA<br>TCGGAGCACTGCTGTTCGACAGCGGAGAAACGACGAAGCAACAAGACT-GAAGAGAACAGCAAGAAGAAGATACAAGAAGAAAGAACAGAA<br>TCTGCTACCTGCAGGAAATCTTCAGCAACGAAATGGCAAAGGTCGACGACAGCTTCTTC-CACAGACTGGAAGAAAGCTTCCTGGTCGAAGAAG<br>ACAAGAAGCACGAAAGACACCCGATCTTCGGAAACATCGTCGACGAAGTCGCATAC-CACGAAAAGTACCCGACAATCTACCACCTGAGAAAGA<br>AGCTGGTCGACAGCACAGACAAGGCAGACCTGAGACTGATCTACCTGGCACTGGCACA-CATGATCAAGTTCAGAGGACACTTCCTGATCGAAG | 59 |

-continued

Sequence Table
The following sequence table provides a listing of sequences disclosed herein. It is understood that if a DNA sequence (comprising Ts) is referenced with respect to an RNA, then Ts should be replaced with Us(which may be modified or unmodified depending on the context), and vice versa.

| Description | Sequence | SEQ ID No. |
|---|---|---|
| XBG, ORF corresponding to SEQ ID NO: 4, Kozak sequence, and 3' UTR of XBG | GAGACCTGAACCCGGACAACAGCGACGTCGACAAGCTGTTCATCCAGCTGGTCCAGA-CATACAACCAGCTGTTCGAAGAAAACCCGATCAACG CAAGCGGAGTCGACGCAAAGGCAATCCTGAGCGCAAGACTGAGCAAGAGCAGAAGACTG-GAAAACCTGATCGCACAGCTGCCGGGAGAAAGA AGAACGGACTGTTCGGAAACCTGATCGCACTGAGCCTGGGACTGACACCGAACTT-CAAGAGCAACTTCGACCTGGCAGAAGACGCAAAGCTGC AGCTGAGCAAGGACACATACGACGACCTGGACAACCTGCTGGCACAGATCGGA-GACCAGTACGCAGACCTGTTCCTGGCAGCAAAGAACC TGAGCGACGCAATCCTGCTGAGCGACATCCTGAGAGTCAACACAGAAAT-CACAAAGGCACCGCTGAGCGCAAGCATGATCAAGAGATACGACG AACACCACCAGGACCTGACACTGCTGAAGGCACTGGTCAGACAGCAGCTGCCG-GAAAAGTACAAGGAAATCTTCTTCGACCAGAGCAAGAACG GATACGCAGGATACATCGACGGAGGAGCAAGCCAGGAAGAATTCTACAAGTTCAT-CAAGCCGATCCTGGAAAAGATGGACGGAACGAAGAAC TGCTGGTCAAGCTGAACAGAGAAGACCTGCTGAGAAAGCAGAGAACATTCGACAACG-GAAGCATCCCGCACCAGATCCACCTGGGAGAACTGC ACGCAATCCTGAGAAGACAGGAAGACTTCTACCCGTTCCTGAAGGACAACAGAGAAAA-GATCGAAAAGATCCTGACATTCAGAATCCCGTACT ACGTCGGACCGCTGGCAAGAGGAAACAGCAGATTCGCATG-GATGACAAGAAAGAGCGAAGAAACAATCACACCGTGGAACTTCGAAGAAGTCG TCGACAAGGGAGCAAGCGCACAGAGCTT-CATCGAAAGAATGACAAACTTCGACAAGAACCTGCCGAACGAAAAGGTCCTGCCGAAGCACAGCC TGCTGTACGAATACTTCACAGTCTACAACGAACTGACAAAGGTCAAGTACGT-CACAGAAGGAATGAGAAAGCCGGCATTCCTGAGCGGAGAAC AGAAGAAGGCAATCGTCGACCTGCTGTTCAAGACAAACAGAAAGGTCACAGT-CAAGCAGCTGAAGGAAGACTACTTCAAGAAGATCGAATGCT TCGACAGCGTCGAAATCAGCGGAGTCGAAGACAGATTCAACGCAAGCCTGGGAACATAC-CACGACCTGCTGAAGATCATCAAGGACAAGGACT TCCTGGACAACGAAGAAAACGAAGACATCCTGGAAGA-CATCGTCCTGACACTGACACTGTTCGAAGACAGAGAAATGATCGAAGAAAGACTGA AGACATACGCACACCTGTTCGACGACAAGGTCATGAAGCAGCTGAAGAGAAGAAGATA-CACAGGATGGGGAAGACTGAGCAGAAAGCTGATCA ACGGAATCAGAGACAAGCAGAGCGGAAAGACAATCCTGGACTTCCTGAAGAGCGACGGAT-TCGCAAACAGAAACTTCATGCAGCTGATCCACG ACGACAGCCTGACATTCAAGGAAGACATCCAGAAGGCACAGGTCAGCGGACAGGGA-GACAGCCTGCACGAACACATCGCAAACCTGGCAGGAA GCCCGGCAATCAAGAAGGGAATCCTGCAGACAGTCAAGGTCGTCGACGAACTGGT-CAAGGTCATGGGAAGACACAAGCCGGAAAACATCGTCA TCGAAATGGCAAGAGAAAACCA-GACAACACAGAAGGGACAGAAGAACAGCAGAGAAAGAATGAAGAGAATCGAAGAAGGAATCAAGGAACTGG GAAGCCAGATCCT-GAAGGAACACCCGGTCGAAAACACACAGCTGCAGAACGAAAAGCTGTACCTGTACTACCTGCAGAACGGAAGAGACATGT ACGTCGACCAGGAACTGGACATCAACAGACTGAGCGACTACGACGTCGACCA-CATCGTCCCGCAGAGCTTCCTGAAGGACGACAGCATCGACA ACAAGGTCCTGACAAGAAGCGACAAGAACAGAG-GAAAGAGCGACAACGTCCCGAGCGAAGAAGTCGTCAAGAAGATGAAGAACTACTGGAGAC AGCTGCTGAACGCAAAGCTGAT-CACACAGAGAAAGTTCGACAACCTGACAAAGGCAGAGAGAGGAGGACTGAGCGAACTGGACAAGGCAGGAT TCATCAAGAGACAGCTGGTCGAAACAAGACAGATCACAAAGCACGTCGCACA-GATCCTGGACAGCAGAATGAACACAAAGTACGACGAAAACG ACAAGCTGATCAGAGAAGTCAAGGTCATCACACT-GAAGAGCAAGCTGGTCAGCGACTTCAGAAAGGACTTCCAGTTCTACAAGGTCAGAGAAA TCAACAACTACCACCACGCACACGACGCATACCTGAACGCAGTCGTCGGAACAGCACT-GATCAAGAAGTACCCGAAGCTGGAAAGCGAATTCG TCTACGGAGACTACAAGGTCTACGACGTCAGAAAGATGATCGCAAAGAGCGAACAG-GAAATCGGAAAGGCAACAGCAAAGTACTTCTTCTACA GCAACATCATGAACTTCTTCAAGACAGAAATCACACTGGCAAACGGAGAAATCAGAAAGA-GACCGCTGATCGAAACAAACGGAGAAACAGGAG AAATCGTCTGGGACAAGGGAAGAGACTTCGCAACAGTCAGAAAGGTCCTGAG-CATGCCGCAGGTCAACATCGTCAAGAAGACAGAAGTCCAGA CAGGAGGATTCAGCAAGGAAAAGCATCCTGCCGAAGAGAAACAGCGACAAGCT-GATCGCAAGAAAGAAGGACTGGGACCCGAAGAAGTACGGAG GATTCGACAGCCCGACAGTCGCATACAGCGTCCTGGTCGTCGCAAAGGTCGAAAGG-GAAAGAGCAAGAAGCTGAAGAGCGTCAAGGAACTGC TGGGAATCACAATCATGGAAAAGCAGCTTCGAAAAGAACCCGATCGACTTCCTG-GAAGCAAAGGGATACAAGGAAGTCAAGAAGGACCTGA TCATCAAGCTGCCGAAGTACAGCCTGTTCGAACTGGAAACG-GAAGAAAGAGAATGCTGGCAAGCGCAGGAGAACTGCAGAAGGGAAACGAAC TGGCACTGCCGAGCAAGTACGTCAACTTCCTGTACCTGGCAAGCCACTACGAAAAGCT-GAAGGGAAGCCCGGAAGACAACGAACAGAAGCAGC TGTTCGTCGAACAGCACAAGCACTACCTGGACGAAATCATCGAACAGATCAGCGAAT-TCAGCAAGAGAGTCATCCTGGCAGACGCAAACCTGG ACAAGGTCCTGAGCGCATACAACAAGCACAGAGACAAGCC-GATCAGAGAACAGGCAGAAAACATCATCCACCTGTTCACACTGACAAACCTGG GAGCACCGGCAGCATTCAAGTACTTCGACACAACAATCGACAGAAAGAGATA-CACAAGCACAAAGGAAGTCCTGGACGCAACACTGATCCACC |  |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | AGAGCATCACAGGACTGTACGAAACAAGAATCGACCTGAGCCAGCTGGGAGGAGACGGAG-<br>GAGGAAGCCCGAAGAAGAAGAGAAAGGTCTAGc<br>tagcaccagcctcaagaacacccgaatggagtctctaagctacataataccaactta-<br>cactttacaaaatgttgtcccccaaaatgtagccat<br>tcgtatctgctcctaataaaaagaaagtttcttcacattctctcgag | |
| Cas9 transcript with AGG as first three nucleotides for use with CleanCap ™, 5' UTR from XBG, ORF corresponding to SEQ ID NO: 4, Kozak sequence, and 3' UTR of XBG | AGGaagctcagaataaacgctcaactttggccggatctgccacCATGGACAAGAAGTA-<br>CAGCATCGGACTGGACATCGGAACAAACAGCGTCG<br>GATGGGCAGTCATCACAGACGAATACAAGGTCCCGAGCAAGAAGTTCAAGGTCCTGG-<br>GAAACACAGACAGACACAGCATCAAGAAGAACCTGA<br>TCGGAGCACTGCTGTTCGACAGCGGAGAAACAGCAGAAGCAACAAGACT-<br>GAAGAGAACAGCAAGAAGAAGATACACAAGAAGAAAGAACAGAA<br>TCTGCTACCTGCAGGAAATCTTCAGCAACGAAATGGCAAAGGTCGACGACAGCTTCTTC-<br>CACAGACTGGAAGAAAGCTTCCTGGTCGAAGAAG<br>ACAAGAAGCACGAAAGACACCCGATCTTCGGAAACATCGTCGACGAAGTCGCATAC-<br>CACGAAAAGTACCCGACAATCTACCACCTGAGAAAGA<br>AGCTGGTCGACAGCACAGACAAGGCAGACCTGAGACTGATCTACCTGGCACTGGCACA-<br>CATGATCAAGTTCAGAGGACACTTCCTGATCGAAG<br>GAGACCTGAACCCGGACAACAGCGACGTCGACAAGCTGTTCATCCAGCTGGTCCAGA-<br>CATACAACCAGCTGTTCGAAGAAAACCCGATCAACG<br>CAAGCGGAGTCGACGCAAAGGCAATCCTGAGCGCAAGACTGAGCAAGAGCAGAAGACTG-<br>GAAAACCTGATCGCACAGCTGCCGGGAGAAAAGA<br>AGAACGGACTGTTCGGAAACCTGATCGCACTGAGCCTGGGACTGACACCGAACTT-<br>CAAGAGCAACTTCGACCTGGCAGAAGACGCAAAGCTGC<br>AGCTGAGCAAGGACACATACGACGACGACCTGGACAACCTGCTGGCACAGATCGGA-<br>GACCAGTACGCAGACCTGTTCCTGGCAGCAAAGAACC<br>TGAGCGACGACAATCCTGCTGAGCGACATCCTGAGAGTCAACACAGAAAT-<br>CACAAAGGCACCGCTGAGCGCAAGCATGATCAAGAGATACGACG<br>AACACCACCAGGACCTGACACTGCTGAAGGCACTGGTCAGACAGCAGCTGCCG-<br>GAAAAGTACAAGGAAATCTTCTTCGACCAGAGCAAGAACG<br>GATACGCAGGATACATCGACGGAGGAGCAAGCCAGGAAGAATTCTACAAGTTCAT-<br>CAAGCCGATCCTGGAAAAGATGGACGGAACAGAAGAAC<br>TGCTGGTCAAGCTGAACAGAGAAGACCTGCTGAGAAAGCAGAGAACATTCGACAACG-<br>GAAGCATCCCGCACCAGATCCACCTGGGAGAACTGC<br>ACGCAATCCTGAGAAGACAGGAAGACTTCTACCCGTTCCTGAAGGACAACAGAGAAAA-<br>GATCGAAAAGATCCTGACATTCAGAATCCCGTACT<br>ACGTCGGACCGCTGGCAAGAGGAAACAGCAGATTCGCATG-<br>GATGACAAGAAAGAGCGAAGAAACAATCACACCGTGGAACTTCGAAGAAGTCG<br>TCGACAAGGGAGCAAGCGCACAGAGCTT-<br>CATCGAAAGAATGACAAACTTCGACAAGAACCTGCCGAACGAAAAGGTCCTGCCGAAGCACAGCC<br>TGCTGTACAATACTTCACAGTCTACAACGAACTGACAAAGGTCAAGTACGT-<br>CACAGAAGGAATGAGAAAGCCGGCATTCCTGAGCGGAGAAC<br>AGAAGAAGGCAATCGTCGACCTGCTGTTCAAGACAAACAGAAAGGTCACAGT-<br>CAAGCAGCTGAAGGAAGACTACTTCAAGAAGATCGAATGCT<br>TCGACAGCGTCGAAATCAGCGGAGTCGAAGACAGATTCAACGCAAGCCTGGGAACATAC-<br>CACGACCTGCTGAAGATCATCAAGGACAAGGACT<br>TCCTGGACAACGAAGAAAACGAAGACATCCTGGAAGA-<br>CATCGTCCTGACACTGACACTGTTCGAAGACAGAGAAATGATCGAAGAAAGACTGA<br>AGACATACGCACACCTGTTCGACGACAAGGTCATGAAGCAGCTGAAGAGAAGAAGATA-<br>CACAGGATGGGGAAGACTGAGCAGAAAGCTGATCA<br>ACGGAATCAGAGACAAGCAGAGCGGAAAGAACAATCCTGGACTTCCTGAAGAGCGACGGAT-<br>TCGCAAACAGAAACTTCATGCAGCTGATCCACACG<br>ACGACAGCCTGACATTCAAGGAAGACATCCAGAAGGCACAGGTCAGCGGACAGGGA-<br>GACAGCCTGCACGAACACATCGCAAACCTGGCAGGAA<br>GCCCGGCAATCAAGAAGGGAATCCTGCAGACAGTCAAGGTCGTCGACGAACTGGT-<br>CAAGGTCATGGGAAGACACAAGCCGGAAAACATCGTCA<br>TCGAAATGGCAAGAGAAAACCA-<br>GACAACACAGAAGGGACAGAAGAACAGCAGAGAAAGAATGAAGAGAATCGAAGAAGGAATCAAGGAACTGG<br>GAAGCCAGATCCT-<br>GAAGGAACACCCGGTCGAAAACACACAGCTGCAGAACGAAAAGCTGTACCTGTACTACCTGCAGAACGGAAGAGACATGT<br>ACGTCGACCAGGAACTGGACATCAACAGACTGAGCGACTACGACGTCGACCA-<br>CATCGTCCCGCAGAGCTTCCTGAAGGACGACAGCATCGACA<br>ACAAGGTCCTGACAAGAAGCGACAAGAACAGAGGAAAGAGCGACAACGTCCCGAG-<br>GAAGAAGTCGTCAAGAAGATGAAGAACTACTGGAGAC<br>AGCTGCTGAACGCAAAGCTGAT-<br>CACACACAGAGAAAGTTCGACAACCTGACAAAGGCAGAGAGAGGAGGACTGAGCGAACTGGACAAGGCAGGAT<br>TCATCAAGAGACAGCTGGTCGAAACAAGACAGATCACAAAGCACGTCGCACA-<br>GATCCTGGACAGCAGAATGAACACAAAGTACGACGAAAACG<br>ACAAGCTGATCAGAGAAGTCAAGGTCATCACACT-<br>GAAGAGCAAGCTGGTCAGCGACTTCAGAAAGGACTTCCAGTTCTACAAGGTCAGAGAAA<br>TCAACAACTACCACCACGCACACGACGCATACCTGAACGCAGTCGTCGGAACAGCACT-<br>GATCAAGAAGTACCCGAAGCTGGAAAGCGAATTCG<br>TCTACGGAGACTACAAGGTCTACGACGTCAGAAAGATGATCGCAAAGAGCGAACAG-<br>GAAATCGGAAAGGCAACAGCAAAGTACTTCTTCTACA<br>GCAACATCATGAACTTCTTCAAGACAGAAATCACACTGGCAAACGGAGAAATCAGAAAGA-<br>GACCGCTGATCGAAACAAACGGAGAAACAGGAG | 60 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | AAATCGTCTGGGACAAGGGAAGAGACTTCGCAACAGTCAGAAAGGTCCTGAG-<br>CATGCCGCAGGTCAACATCGTCAAGAAGACAGAAGTCCAGA<br>CAGGAGGATTCAGCAAGGAAAGCATCCTGCCGAAGAGAAACAGCGACAAGCT-<br>GATCGCAAGAAAGAAGGACTGGGACCCGAAGAAGTACGGAG<br>GATTCGACAGCCCGACAGTCGCATACAGCGTCCTGGTCGTCGCAAAGGTCGAAAAGG-<br>GAAAGAGCAAGAAGCTGAAGAGCGTCAAGGAACTGC<br>TGGGAATCACAATCATGGAAAGCAGCTTCGAAAAGAACCCGATCGACTTCCTG-<br>GAAGCAAAGGGATACAAGGAAGTCAAGAAGGACCTGA<br>TCATCAAGCTGCCGAAGTACAGCCTGTTCGAACTGGAAACG-<br>GAAGAAAGAGAATGCTGGCAAGCGCAGGAGAACTGCAGAAGGGAAACGAAC<br>TGGCACTGCCGAGCAAGTACGTCAACTTCCTGTACCTGGCAAGCCACTACGAAAAGCT-<br>GAAGGGAAGCCCGGAAGACAACGAACAGAAGCAGC<br>TGTTCGTCGAACAGCACAAGCACTACCTGGACGAAATCATCGAACAGATCAGCGAAT-<br>TCAGCAAGAGAGTCATCCTGGCAGACGCAAACCTGG<br>ACAAGGTCCTGAGCGCATACAACAAGCACAGAGACAAGCC-<br>GATCAGAGAACAGGCAGAAAACATCATCCACCTGTTCACACTGACAAACCTGG<br>GAGCACCGGCAGCATTCAAGTACTTCGACACAACAATCGACAGAAAGAGATA-<br>CACAAGCACAAAGGAAGTCCTGGACGCAACACTGATCCACC<br>AGAGCATCACAGGACTGTACGAAACAAGAATCGACCTGAGCCAGCTGGGAGGAGACGGAG-<br>GAGGAAGCCCGAAGAAGAAGAGAAAGGTCTAGc<br>tagcaccagcctcaagaacacccgaatggagtctctaagctacataataccaactta-<br>cactttacaaaatgttgtccccaaaatgtagccat<br>tcgtatctgctcctaataaaaagaaagtttcttcacattctctcgag | |
| Cas9<br>trans-<br>cript<br>with<br>AGG<br>as<br>first<br>three<br>nucleo-<br>tides<br>for<br>use<br>with<br>Clean<br>Cap ™,<br>5' UTR<br>from<br>HSD,<br>ORF<br>corres-<br>pond-<br>ing to<br>SEQ ID<br>NO: 4,<br>Kozak<br>se- | AGGTCCCGCAGTCGGCGTCCAGCGGCTCTGCTTGTTCGTGTGTGTGTCGTTGCAGGCCTT-<br>ATTCGGATCCGCCACCATGGACAAGAAGTACAG<br>CATCGGACTGGACATCGGAACAAACAGCGTCGGATGGGCAGTCATCACAGACGAATA-<br>CAAGGTCCCGAGCAAGAAGTTCAAGGTCCTGGGAAA<br>CACAGACAGACACAGCATCAAGAAGAACCTGATCGGAGCACTGCTGTTCGACAGCG-<br>GAGAAACAGCAGAAGCAACAAGACTGAAGAGAACAGC<br>AAGAAGAAGATACACAAGAAGAAAGAACAGAATCTGCTACCTGCAG-<br>GAAATCTTCAGCAACGAAATGGCAAAGGTCGACGACAGCTTCTTCCA<br>CAGACTGGAAGAAAGCTTCCTGGTCGAAGAAGACAAGAAGCACGAAAGACACCC-<br>GATCTTCGGAAACATCGTCGACGAAGTCGCATACCACGA<br>AAAGTACCCGACAATCTACCACCTGAGAAAGAAGCTGGTCGACAGCACAGACAAGGCA-<br>GACCTGAGACTGATCTACCTGGCACTGGCACACAT<br>GATCAAGTTCAGAGGACACTTCCTGATCGAAGGAGACCT-<br>GAACCCGGACAACAGCGACGTCGACAAGCTGTTCATCCAGCTGGTCCAGACATA<br>CAACCAGCTGTTCGAAGAAAACCCGATCAACGCAAGCGGAGTCGACGCAAAGGCAATCCT-<br>GAGCGCAAGACTGAGCAAGAGCAGAAGACTGGA<br>AAACCTGATCGCACAGCTGCCGGGAGAAAAGAAGAACGGACTGTTCGGAAACCT-<br>GATCGCACTGAGCCTGGGACTGACACCGAACTTCAAGAG<br>CAACTTCGACCTGGCAGAAGACGCAAAGCTGCAGCTGAGCAAGGACACAT-<br>ACGACGACGACCTGGACAACCTGCTGGCACAGATCGGAGACCA<br>GTACGCAGACCTGTTCCTGGCAGCAAAGAACCTGAGCGACGCAATCCTGCTGAGCGA-<br>CATCCTGAGAGTCAACACAGAAATCACAAAGGCACC<br>GCTGAGCGCAAGCATGATCAAGAGATACGACGAACACCACCAGGACCTGACACTGCT-<br>GAAGGCACTGGTCAGACAGCAGCTGCCGGAAAAGTA<br>CAAGGAAATCTTCTTCGACCAGAGCAAGAACGGATACGCAGGATACATCGACGGAG-<br>GAGCAAGCCAGGAAGAATTCTACAAGTTCATCAAGCC<br>GATCCTGGAAAAGATGGACGGAACAGAAGAACTGCTGGTCAAGCTGAACAGAGAA-<br>GACCTGCTGAGAAAGCAGAGAACATTCGACAACGGAAG<br>CATCCCGCACCAGATCCACCTGGGAGAACTGCACGCAATCCTGAGAAGACAGGAA-<br>GACTTCTACCCGTTCCTGAAGGACAACAGAGAAAAGAT<br>CGAAAAGATCCTGACATTCAGAATCCCGTACTACGTCGGACCGCTGGCAAGAG-<br>GAAACAGCAGATTCGCATGGATGACAAGAAAGAGCGAAGA<br>AACAATCACACCGTGGAACTTCGAAGAAGTCGTCGACAAGGGAGCAAGCGCACAGAGCTT-<br>CATCGAAAGAATGACAAACTTCGACAAGAACCT<br>GCCGAACGAAAAGGTCCTGCCGAAGCACAGCCTGCTGTACGAATACTTCACAGTCTA-<br>CAACGAACTGACAAAGGTCAAGTACGTCACAGAAGG<br>AATGAGAAAGCCGGCCATTCCTGAGCGGAGAACAGAAGAAGGCAATCGTCGACCTGCTGTT-<br>CAAGACAAACAGAAAGGTCACAGTCAAGCAGCT<br>GAAGGAAGACTACTTCAAGAAGATCGAATGCTTCGACAGCGTCGAAATCAGCG-<br>GAGTCGAAGACAGATTCAACGCAAGCCTGGGAACATACCA<br>CGACCTGCTGAAGATCATCAAGGACAAGGACTTCCTGGACAACGAAGAAAACGAAGA-<br>CATCCTGGAAGACATCGTCCTGACACTGACACTGTT<br>CGAAGACAGAGAAATGATCGAAGAAGACTGAAGACAT-<br>ACGCACACCTGTTCGACGACAAGGTCATGAAGCAGCTGAAGAGAAGAAGATACAC<br>AGGATGGGGAAGACTGAGCAGAAAGCTGATCAACGGAATCAGAGACAAGCAGAGCGGAAA-<br>GACAATCCTGGACTTCCTGAAGAGCGACGGATT<br>CGCAAACAGAAACTTCATGCAGCTGATCCACGACGACAGCCTGACATTCAAGGAAGA-<br>CATCCAGAAGGCACAGGTCAGCGGACAGGGAGACAG<br>CCTGCACGAACACATCGCAAACCTGGCAGGAAGCCCGGCAATCAAGAAGGGAATCCTGCA-<br>GACAGTCAAGGTCGTCGACGAACTGGTCAAGGT<br>CATGGGAAGACACAAGCCGGAAAACATCGTCATCGAAATGGCAAGAGAAAACCA-<br>GACAACACAGAAGGGACAGAAGAACAGCAGAGAAAGAAT | 61 |

-continued

Sequence Table
The following sequence table provides a listing of sequences disclosed herein. It is understood that if
a DNA sequence (comprising Ts) is referenced with respect to an RNA, then Ts should
be replaced with Us (which may be modified or unmodified depending on the context), and vice versa.

| Description | Sequence | SEQ ID No. |
|---|---|---|
| quence, and 3' UTR of ALB | GAAGAGAATCGAAGAAGGAATCAAGGAACTGGGAAGCCAGATCCT-GAAGGAACACCCGGTCGAAAACACACAGCTGCAGAACGAAAAGCTGTA CCTGTACTACCTGCAGAACGGAAGAGACATGTACGTCGACCAGGAACTGGACATCAACA-GACTGAGCGACTACGACGTCGACCACATCGTCCC GCAGAGCTTCCTGAAGGACGACAG-CATCGACAACAAGGTCCTGACAAGAAGCGACAAGAACAGAGGAAAGAGCGACAACGTCCCGAGCGAAGA AGTCGTCAAGAAGATGAAGAACTACTGGAGACAGCTGCTGAACGCAAAGCTGAT-CACACAGAGAAAGTTCGACAACCTGACAAAGGCAGAGAG AGGAGGACTGAGCGAACTGGACAAGGCAGGATTCATCAAGAGACAGCTGGTCGAAACAA-GACAGATCACAAAGCACGTCGCACAGATCCTGGA CAGCAGAATGAACACAAAGTACGACGAAAACGACAAGCTGATCAGAGAAGTCAAGGTCAT-CACACTGAAGAGCAAGCTGGTCAGCGACTTCAG AAAGGACTTCCAGTTCTACAAGGTCAGAGAAATCAACAACTACCACCACGCACACGACG-CATACCTGAACGCAGTCGTCGGAACAGCACTGAT CAAGAAGTACCCGAAGCTGGAAAGCGAATTCGTCTACGGAGACTACAAGGTC-TACGACGTCAGAAAGATGATCGCAAAGAGCGAACAGGAAAT CGGAAAGGCAACAGCAAAGTACTTCTTCTACAGCAACATCATGAACTTCTTCAA-GACAGAAATCACACTGGCAAACGGAGAAATCAGAAAGAG ACCGCTGATCGAAACAAACGGAGAAACAGGAGAAATCGTCTGGGACAAGGGAAGA-GACTTCGCAACAGTCAGAAAGGTCCTGAGCATGCCGCA GGTCAACATCGTCAAGAAGACAGAAGTCCAGACAGGAGGAT-TCAGCAAGGAAAGCATCCTGCCGAAGAGAAACAGCGACAAGCTGATCGCAAG AAAGAAGGACTGGGACCCGAAGAAGTACGAGGATTCGACAGCCCGACAGTCGCATA-CAGCGTCCTGGTCGTCGCAAAGGTCGAAAAGGGAAA GAGCAAGAAGCTGAAGAGCGTCAAGGAACTGCTGGGAATCACAATCATG-GAAAGAAGCAGCTTCGAAAAGAACCCGATCGACTTCCTGGAAGC AAAGGGATACAAGGAAGTCAAGAAGGACCTGATCATCAAGCTGCCGAAGTA-CAGCCTGTTCGAACTGGAAAACGGAAGAAAGAGAATGCTGGC AAGCGCAGGAGAACTGCAGAAGGGAAACGAACTGGCACTGCCGAGCAAGTACGT-CAACTTCCTGTACCTGGCAAGCCACTACGAAAAGCTGAA GGGAAGCCCGGAAGACAACGAACAGAAGCAGCTGTTCGTCGAACAGCACAAGCAC-TACCTGGACGAAATCATCGAACAGATCAGCGAATTCAG CAAGAGAGTCATCCTGGCAGACGCAAACCTGGACAAGGTCCTGAGCGCATA-CAACAAGCACAGAGACAAGCCGATCGAGAACAGGCAGAAAA CATCATCCACCTGTTCACACTGACAAACCTGGGAGCACCGGCAGCATT-CAAGTACTTCGACACAACAATCGACAGAAAGAGATACACAAGCAC AAAGGAAGTCCTGGACGCAACACTGATCCACCAGAGCAT-CACAGGACTGTACGAAACAAGAATCGACCTGAGCCAGCTGGGAGGAGACGGAGG AGGAAGCCCGAAGAAGAAGAGAAAGGTCTAGCTAGCCATCACATT-TAAAAGCATCTCAGCCTACCATGAGAATAAGAGAAAGAAAATGAAGAT CAATAGCTTATTCATCTCTTTTTCTTTTTCGTTGGTGTAAAGC-CAACACCCTGTCTAAAAAACATAAATTTCTTTAATCATTTTGCCTCTTTTCTCTGTGCTTCAATTAATAAAAAATGAAAGAACCTCGAG | |
| 30/30/39 poly-A sequence | AAAAAAAAAAAAAAAAAAAAAAAAAAAAAAGCGAAAAAAAAAAAAAAAAAAAAAAAAAAAAACCGAAAAAAAAAAAAAAAAAAAAAAAAAAAAA AAAAAAAAAAA | 62 |
| poly-A 100 sequence | AAAAAAAAAAAAAAAAAAAAAAAAAAAAAAAAAAAAAAAAAAAAAAAAAAAAAAAAAAAAAAAAAAAAAAAAAAAAAAAAAAAAAAAAAAAAAAAA | 63 |
| G209 guide RNA | mC*mC*mA*GUCCAGCGAGGCAAAGGGUUUUAGAGCUAGAAAUAGCAAGUUAAAAUAAGGCUAGUCCGUUAUCAACUUGAAAAAGUGGCACCG AGUCGGUGCmU*mU*mU*U | 64 |
| ORF encoding *Neisseria meningitidis* Cas9 | ATGGCAGCATTCAAGCCGAACTCGATCAACTACATCCTGGGACTGGACATCGGAATCG-CATCGGTCGGATGGGCAATGGTCGAAATCGACGAA GAAGAAAACCCGATCAGACTGATCGACCTGG-GAGTCAGAGTCTTCGAAAGAGCAGAAGTCCCGAAGACAGGAGACTCGCTGGCAATGGCAAGA AGACTGGCAAGATCGGTCAGAAGACTGACAAGAAGAAGAGCACACAGACTGCT-GAGAACAAGAAGACTGCTGAAGAGAGAAGGAGTCCTGCAG GCAGCAAACTTCGACGAAAACGGACTGATCAAGTCGCTGCCGAACACACCGTGGCAGCT-GAGAGCAGCAGCACTGGACAGAAAGCTGACACCG CTGGAATGGTCGGCAGTCCTGCTGCACCTGATCAAGCACAGAGGA-TACCTGTCGCAGAGAAAGAACGAAGGAGAAACAGCAGACAAGGAACTG GGAGCACTGCTGAAGGGAGTCGCAGGGAAACGCACACGCACTGCAGACAGGA-GACTTCAGAACACCGGCAGAACTGGCACTGAACAAGTTCGAA AAGGAATCGGGACACATCAGAAACCAGAGATCGGACTACTCGCACACAT-TCTCGAGAAAGGACCTGCAGGCAGAACTGATCCTGCTGTTCGAA AAGCAGAAGGAATTCGGAAACCCGCACGTCTCGGGAGGACT-GAAGGAAGGAATCGAAACACTGCTGATGCACAGAGACCGGCACTGTCGGGA GACGCAGTCCGAGAAGATGCTGGGACACTGCACAT-TCGAACCGGCAGAACCGAAGGCAGCAAAGAACACATACACAGCGAAAGATTCATCTGG CTGACAAAGCTGAACAACCTGAGAATCCTGGAACAGGGATCGGAAAGACCGCTGACA-GACACAGAAAGAGCAACACTGATGGACGAACCGTAC | 65 |

-continued

Sequence Table

The following sequence table provides a listing of sequences disclosed herein. It is understood that if a DNA sequence (comprising Ts) is referenced with respect to an RNA, then Ts should be replaced with Us(which may be modified or unmodified depending on the context), and vice versa.

| Description | Sequence | SEQ ID No. |
|---|---|---|
| | AGAAAGTCGAAGCTGACATACGCACAGGCAAGAAAGCTGCTGGGACTGGAAGACACAG-<br>CATTCTTCAAGGGACTGAGATACGGAAAGGACAAC<br>GCAGAAGCATCGACACTGATGGAAATGAAGGCATACCACGCAATCTCGAGAGCACTG-<br>GAAAAGGAAGGACTGAAGGACAAGAAGTCGCCGCTG<br>AACCTGTCGCCGGAACTGCAGGACGAAATCGGAACAGCATTCTCGCTGTTCAAGACA-<br>GACGAAGACATCACAGGAAGACTGAAGGACAGAATC<br>CAGCCGGAAATCCTGGAAGCACTGCTGAAGCACATCTCGTTCGACAAGTTCGTCCA-<br>GATCTCGCTGAAGGCACTGAGAAGAATCGTCCCGCTG<br>ATGGAACAGGGAAAGAGATACGACGAAGCATGCGCAGAAATCTACGGAGACCACTACG-<br>GAAAGAAGAACACAGAAGAAAAGATCTACCTGCCG<br>CCGATCCCGGCAGACGAAATCAGAAACCCGGTCGTCCT-<br>GAGAGCACTGTCGCAGGCAAGAAAGGTCATCAACGGAGTCGTCAGAAGATACGGA<br>TCGCCGGCAAGAATCCACATCGAAACAGCAAGAGAAGTCGGAAAGTCGTT-<br>CAAGGACAGAAAGGAAATCGAAAAGAGACAGGAAGAAAACAGA<br>AAGGACAGAGAAAAGGCAGCAGCAAAGTTCAGAGAATACTTCCCGAACTTCGTCG-<br>GAGAACCGAAGTCGAAGGACATCCTGAAGCTGAGACTG<br>TACGAACAGCAGCACGGAAAGTGCCTGTACTCGGGAAAGGAAATCAACCTGGGAAGACT-<br>GAACGAAAAGGGATACGTCGAAATCGACCACGCA<br>CTGCCGTTCTCGAGAACATGGGACGACTCGTTCAACAACAAGGTCCTGGTCCTGGGATCG-<br>GAAAACCAGAACAAGGGAAACCAGACACCGTAC<br>GAATACTTCAACGGAAAGGACAACTCGAGAGAATGGCAGGAATT-<br>CAAGGCAAGAGTCGAAACATCGAGATTCCCGAGATCGAAGAAGCAGAGA<br>ATCCTGCTGCAGAAGTTCGACGAAGACGGATTCAAGGAAAGAAACCTGAACGACACAAGA-<br>TACGTCAACAGATTCCTGTGCCAGTTCGTCGCA<br>GACAGAATGAGACTGACAGGAAAGGGAAAGAAGAGAGTCTTCGCATCGAACGGACAGAT-<br>CACAAACCTGCTGAGAGGATTCTGGGGACTGAGA<br>AAGGTCAGAGCAGAAAACGACAGACACCACGCACTGGACGCAGTCGTCGTCG-<br>CATGCTCGACAGTCGCAATGCAGCAGAAGATCACAAGATTC<br>GTCAGATACAAGGAAATGAACGCATTCGACGGAAAGACAATCGACAAGGAAACAG-<br>GAGAAGTCCTGCACCAGAAGACACACTTCCCGCAGCCG<br>TGGGAATTCTTCGCACAGGAAGTCATGATCAGAGTCTTCGGAAAGCCGGACGGAAAGCCG-<br>GAATTCGAAGAAGCAGACACACTGGAAAAGCTG<br>AGAACACTGCTGGCAGAAAAGCTGTCGTCGAGACCGGAAGCAGTCCACGAATACGT-<br>CACACCGCTGTTCGTCTCGAGAGCACCGAACAGAAAG<br>ATGTCGGGACAGGGACACATGGAAACAGTCAAGTCGGCAAAGA-<br>GACTGGACGAAGGAGTCTCGGTCCTGAGAGTCCCGCTGACACAGCTGAAG<br>CTGAAGGACCTGGAAAAGATGGTCAACAGAGAAAGAGAACCGAAGCTGTACGAAGCACT-<br>GAAGGCAAGACTGGAAGCACACAAGGACGACCCG<br>GCAAAGGCATTCGCAGAACCGTTCTACAAGTACGACAAGGCAG-<br>GAAACAGAACACAGCAGGTCAAGGCAGTCAGAGTCGAACAGGTCCAGAAG<br>ACAGGAGTCTGGGTCAGAAACCACAACGGAATCGCAGACAACGCAACAATGGTCAGAGTA-<br>GACGTCTTCGAAAAGGGAGACAAGTACTACCTG<br>GTCCCGATCTACTCGTGGCAGGTCGCAAAGG-<br>GAATCCTGCCGGACAGAGCAGTCGTCCAGGGAAAGGACGAAGAAGACTGGCAGCTGATCGAC<br>GACTCGTTCAACTTCAAGTTCTCGCTGCACCCGAACGACCTGGTCGAAGTCAT-<br>CACAAAGAAGGCAAGAATGTTCGGATACTTCGCATCGTGC<br>CACAGAGGAACAGGAAACATCAACATCAGAATCCACGACCTGGACCACAAGATCG-<br>GAAAGAACGGAATCCTGGAAGGAATCGGAGTCAAGACA<br>GCACTGTCGTTCCAGAAGTACCAGATCGACGAACTGGGAAAGGAAATCAGACCGTGCA-<br>GACTGAAGAAGAGACCGCCGGTCAGATCCGGAAAG<br>AGAACAGCAGACGGATCGGAATTCGAATCGCCGAAGAAGAAGAGAAAGGTCGAATGA | |
| ORF encoding *Neisseria meningitidis* Cas9 (no start or stop | GCAGCATTCAAGCCGAACTCGATCAACTACATCCTGGGACTGGACATCGGAATCG-<br>CATCGGTCGGATGGGCAATGGTCGAAATCGACGAAGAA<br>GAAAACCCGATCAGACTGATCGACCTGG-<br>GAGTCAGAGTCTTCGAAAGAGCAGAAGTCCCGAAGACAGGAGACTCGCTGGCAATGGCAAGAAGA<br>CTGGCAAGATCGGTCAGAAGACTGACAAGAAGAAGAGCACACAGACTGCT-<br>GAGAACAAGAAGACTGCTGAAGAGAGAAGGAGTCCTGCAGGCA<br>GCAAACTTCGACGAAAACGGACTGATCAAGTCGCTGCCGAACACACCGTGGCAGCT-<br>GAGAGCAGCAGCACTGGACAGAAAGCTGACACCGCTG<br>GAATGGTCGGCAGTCCTGCTGCACCTGATCAAGCACAGAGGA-<br>TACCTGTCGCAGAGAAAGAACGAAGGAGAAACAGCAGACAAGGAACTGGGA<br>GCACTGCTGAAGGGAGTCGCAGGAAACGCACACGCACTGCAGACAGGA-<br>GACTTCAGAACACCGGCAGAACTGGCACTGAACAAGTTCGAAAAG<br>GAATCGGGACACATCAGAAACCAGAGATCGGACTACTCGCACACAT-<br>TCTCGAGAAAGGACCTGCAGGCAGAACTGATCCTGCTGTTCGAAAAG<br>CAGAAGGAATTCGGAAACCCGCACGTCTCGGGAGGACT-<br>GAAGGAAGGAATCGAAACACTGCTGATGACACAGAGACCGGCACTGTCGGGAGAC<br>GCAGTCCAGAAGATGCTGGGACACTGCACAT-<br>TCGAACCGGCAGAACCGAAGGCAGCAAAGAACACATACACAGCAGAAAGATTCATCTGGCTG<br>ACAAAGCTGAACAACCTGAGAATCCTGGAACAGGGATCGGAAAGACCGCTGACA-<br>GACACAGAAAGAGCAACACTGATGGACGAACCGTACAGA<br>AAGTCGAAGCTGACATACGCACAGGCAAGAAAGCTGCTGGGACTGGAAGACACAGCAT-<br>TCTTCAAGGGACTGAGATACGGAAAGGACAACGCA<br>GAAGCATCGACACTGATGGAAATGAAGGCATACCACGCAATCTCGAGAGCACTG-<br>GAAAAGGAAGGACTGAAGGACAAGAAGTCGCCGCTGAAC | 66 |

-continued

Sequence Table
The following sequence table provides a listing of sequences disclosed herein. It is understood that if a DNA sequence (comprising Ts) is referenced with respect to an RNA, then Ts should be replaced with Us(which may be modified or unmodified depending on the context), and vice versa.

| Descrip-<br>tion | Sequence | SEQ<br>ID<br>No. |
|---|---|---|
| codons; suit- able for in- clusion in fusion protein coding sequence) | CTGTCGCCGGAACTGCAGGACGAAATCGGAACAGCATTCTCGCTGTTCAAGACAGACGAA-<br>GACATCACAGGAAGACTGAAGGACAGAATCCAG<br>CCGGAAATCCTGGAAGCACTGCTGAAGCACATCTCGTTCGACAAGTTCGTCCA-<br>GATCTCGCTGAAGGCACTGAGAAGAATCGTCCCGCTGATG<br>GAACAGGGAAAGAGATACGACGAAGCATGCGCAGAAATCTACGGAGACCACTACG-<br>GAAAGAAGAACACAGAAGAAAAGATCTACCTGCCGCCG<br>ATCCCGGCAGACGAAATCAGAAACCCGGTCGTCCT-<br>GAGAGCACTGTCGCAGGCAAGAAAGGTCATCAACGGAGTCGTCAGAAGATACGGATCG<br>CCGGCAAGAATCCACATCGAAACAGCAAGAGAAGTCGGAAAGTCGTT-<br>CAAGGACAGAAAGGAAATCGAAAAGAGACAGGAAGAAAACAGAAAG<br>GACAGAGAAAAGGCAGCAGCAAAGTTCAGAGAATACTTCCCGAACTTCGTCG-<br>GAGAACCGAAGTCGAAGGACATCCTGAAGCTGAGACTGTAC<br>GAACAGCAGCACGGAAAGTGCCTGTACTCGGGAAAGGAAATCAACCTGGGAAGACT-<br>GAACGAAAAGGGATACGTCGAAATCGACCACGCACTG<br>CCGTTCTCGAGAACATGGACGACTCGTTCAACAACAAGGTCCTGGTCCTGGGATCG-<br>GAAAACCAGAACAAGGGAAACCAGACACCGTACGAA<br>TACTTCAACGGAAAGGACAACTCGAGAGAATGGCAGGAATTCAAGGCAAGAGTCGAAA-<br>CATCGAGATTCCCGAGATCGAAGAAGCAGAGAATC<br>CTGCTGCAGAAGTTCGACGAAGACGGATTCAAGGAAAGAAACCTGAACGACACAAGA-<br>TACGTCAACAGATTCCTGTGCCAGTTCGTCGCAGAC<br>AGAATGAGACTGACAGGAAAGGGAAAGAAGAGAGTCTTCGCATCGAACGGACAGAT-<br>CACAAACCTGCTGAGAGGATTCTGGGGACTGAGAAAG<br>GTCAGAGCAGAAAACGACAGACACCACGCACTGGACGCAGTCGTCGTCG-<br>CATGCTCGACAGTCGCAATGCAGCAGAAGATCACAAGATTCGTC<br>AGATACAAGGAAATGAACGCATTCGACGGAAAGACAATCGACAAGGAAACAG-<br>GAGAAGTCCTGCACCAGAAGACACACTTCCCGCAGCCGTGG<br>GAATTCTTCGCACAGGAAGTCATGATCAGAGTCTTCGGAAAGCCGGACGGAAAGCCG-<br>GAATTCGAAGAAGCAGACACACTGGAAAAGCTGAGA<br>ACACTGCTGGCAGAAAAGCTGTCGTCGAGACCGGAAGCAGTCCACGAATACGT-<br>CACACCGCTGTTCGTCTCGAGAGCACCGAACAGAAAGATG<br>TCGGGACAGGGACACATGGAAACAGTCAAGTCGGCAAAGA-<br>GACTGGACGAAGGAGTCTCGGTCCTGAGAGTCCCGCTGACACAGCTGAAGCTG<br>AAGGACCTGGAAAAGATGGTCAACAGAGAAAGAGAACCGAAGCTGTACGAAGCACT-<br>GAAGGCAAGACTGGAAGCACACAAGGACGACCCGGCA<br>AAGGCATTCGCAGAACCGTTCTACAAGTACGACAAGGCAGGAAACAGAACACAGCAGGT-<br>CAAGGCAGTCAGAGTCGAACAGGTCCAGAAGACA<br>GGAGTCTGGGTCAGAAACCACAACGGAATCGCAGACAACGCAACAATGGTCAGAGTA-<br>GACGTCTTCGAAAAGGGAGACAAGTACTACCTGGTC<br>CCGATCTACTCGTGGCAGGTCGCAAAGGGAATCCTGCCGGACAGAGCAGTCGTCCAGG-<br>GAAAGGACGAAGAAGACTGGCAGCTGATCGACGAC<br>TCGTTCAACTTCAAGTTCTCGCTGCACCCGAACGACCTGGTCGAAGTCAT-<br>CACAAAGAAGGCAAGAATGTTCGGATACTTCGCATCGTGCCAC<br>AGAGGAACAGGAAACATCAACATCAGAATCCACGACCTGGACCACAAGATCG-<br>GAAAGAACGGAATCCTGGAAGGAATCGGAGTCAAGACAGCA<br>CTGTCGTTCCAGAAGTACCAGATCGACGAACTGGGAAAGGAAATCAGACCGTGCAGACT-<br>GAAGAAGAGACCGCCGGTCAGATCCGGAAAGAGA<br>ACAGCAGACGGATCGGAATTCGAATCGCCGAAGAAGAAGAGAAAGGTCGAA | |
| Tran- script comp- rising SEQ ID NO: 65 (en- coding *Neisseria menin- gitidis* Cas9) | GGGAGACCCAAGCTGGCTAGCGTTTAAACTTAAGCTTGGATCCGCCACCATGGCAGCATT-<br>CAAGCCGAACTCGATCAACTACATCCTGGGACT<br>GGACATCGGAATCGCATCGGTCGGATGGGCAATGGTCGAAATCGACGAAGAAGAAAACCC-<br>GATCAGACTGATCGACCTGGGAGTCAGAGTCTT<br>CGAAAGAGCAGAAGTCCCGAAGACAGGAGACTCGCTGGCAATGGCAAGAAGACTGGCAA-<br>GATCGGTCAGAAGACTGACAAGAAGAAGAGCACA<br>CAGACTGCTGAGAACAAGAAGACTGCT-<br>GAAGAGAGAAGGAGTCCTGCAGGCAGCAAACTTCGACGAAAACGGACTGATCAAGTCGCTGCCGAA<br>CACACCGTGGCAGCTGAGAGCAGCAGCACTGGACAGAAAGCTGACACCGCTG-<br>GAATGGTCGGCAGTCCTGCTGCACCTGATCAAGCACAGAGG<br>ATACCTGTCGCAGAGAAAGAACGAAGGAGAAACAGCAGACAAGGAACTGGGAGCACTGCT-<br>GAAGGGAGTCGCAGGAAACGCACACGCACTGCA<br>GACAGGAGACTTCAGAACACCGGCAGAACTGGCACT-<br>GAACAAGTTCGAAAAGGAATCGGGACACATCAGAAACCAGAGATCGGACTACTCGCA<br>CACATTCTCGAGAAAGGACCTGCAGGCAGAACT-<br>GATCCTGCTGTTCGAAAAGCAGAAGGAATTCGGAAACCCGCACGTCTCGGGAGGACTGAA<br>GGAAGGAATCGAAACACTGCTGATGACACAGAGACCGGCACTGTCGGGA-<br>GACGCAGTCCAGAAGATGCTGGGACACTGCACATTCGAACCGGC<br>AGAACCGAAGGCAGCAAAGAACACATACACAGCAGAAAGATTCATCTGGCTGACAAAGCT-<br>GAACAACCTGAGAATCCTGGAACAGGGATCGGA<br>AAGACCGCTGACAGACACAGAAAGAGCAACACTGATGGACGAACCGTA-<br>CAGAAAGTCGAAGCTGACATACGCACAGGCAAGAAAGCTGCTGGG<br>ACTGGAAGACACAGCATTCTTCAAGGGACTGAGATACG-<br>GAAAGGACAACGCAGAAGCATCGACACTGATGGAAATGAAGGCATACCACGCAAT<br>CTCGAGAGCACTGGAAAAGGAAGGACTGAAGGACAAGAAGTCGCCGCT-<br>GAACCTGTCGCCGGAACTGCAGGACGAAATCGGAACAGCATTCTC<br>GCTGTTCAAGACAGACGAAGACATCACAGGAAGACTGAAGGACAGAATCCAGCCG-<br>GAAATCCTGGAAGCACTGCTGAAGCACATCTCGTTCGA | 67 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | CAAGTTCGTCCAGATCTCGCTGAAGGCACTGAGAAGAATCGTCCCGCTGATGGAACAGG-<br>GAAAGAGATACGACGAAGCATGCGCAGAAATCTA<br>CGGAGACCACTACGGAAAGAAGAACACAGAAGAAAGATCTACCTGCCGCC-<br>GATCCCGGCAGACGAAATCAGAAACCCGGTCGTCCTGAGAGC<br>ACTGTCGCAGGCAAGAAAGGTCATCAACGGAGTCGTCAGAAGATACG-<br>GATCGCCGGCAAGAATCCACATCGAAACAGCAAGAGAAGTCGGAAA<br>GTCGTTCAAGGACAGAAAGGAAATCGAAAAGAGACAG-<br>GAAGAAAACAGAAAGGACAGAGAAAAGGCAGCAGCAAAGTTCAGAGAATACTTCCC<br>GAACTTCGTCGGAGAACCGAAGTCGAAGGACATCCTGAAGCTGA-<br>GACTGTATACGAACAGCAGCACGGAAAGTGCCTGTACTCGGGAAAGGAAAT<br>CAACCTGGGAAGACTGAACGAAAAGGGATACGTCGAAATCGAC-<br>CACGCACTGCCGTTCTCGAGAACATGGGACGACTCGTTCAACAACAAGGT<br>CCTGGTCCTGGGATCGGAAAACCAGAACAAGGGAAACCAGACACCGTACGAATACTT-<br>CAACGGAAAGGACAACTCGAGAGAATGGCAGGAATT<br>CAAGGCAAGAGTCGAAACATCGAGAT-<br>TCCCGAGATCGAAGAAGCAGAGAATCCTGCTGCAGAAGTTCGACGAAGCGGATTCAAGGAAAGAA<br>CCTGAACGACACAAGATACGTCAACAGATTCCTGTGCCAGTTCGTCGCAGACAGAATGA-<br>GACTGACAGGAAAGGGAAAGAAGAGAGTCTTCGC<br>ATCGAACGGACAGATCACAAACCTGCTGAGAGGATTCTGGGGACT-<br>GAGAAAGGTCAGAGCAGAAAACGACAGACACCACGCACTGGACGCAGT<br>CGTCGTCGCATGCTCGACAGTCGCAATGCAGCAGAAGATCACAAGATTCGTCAGATA-<br>CAAGGAAATGAACGCATTCGACGGAAAGACAATCGA<br>CAAGGAAACAGGAGAAGTCCTGCACCAGAAGACACACTTCCCGCAGCCGTGGGAAT-<br>TCTTCGCACAGGAAGTCATGATCAGAGTCTTCGGAAA<br>GCCGGACGGAAAGCCGGAATTCGAAGAAGCAGACACACTGGAAAAGCT-<br>GAGAACACTGCTGGCAGAAAAGCTGTCGTCGAGACCGGAAGCAGT<br>CCACGAATACGTCACACCGCTGTTCGTCTCGAGAGCACCGAACAGAA-<br>GATGTCGGGACAGGGACACATGGAAACAGTCAAGTCGGCAAAGAG<br>ACTGGACGAAGGAGTCTCGGTCCTGAGAGTCCCGCTGACACAGCTGAAGCT-<br>GAAGGACCTGGAAAAGATGGTCAACAGAGAAAGAGAACCGAA<br>GCTGTACGAAGCACTGAAGGCAAGACTGGAAGCACACAAGGACGACCCGGCAAAGGCAT-<br>TCGCAGAACCGTTCTACAAGTACGACAAGGCAGG<br>AAACAGAACACAGCAGGTCAAGGCAGTCAGAGTCGAACAGGTCCAGAAGACAG-<br>GAGTCTGGGTCAGAAACCACAACGGAATCGCAGACAACGC<br>AACAATGGTCAGAGTAGACGTCTTCGAAAAGGGAGACAAGTACTACCTGGTCCCGATC-<br>TACTCGTGGCAGGTCGCAAAGGGAATCCTGCCGGA<br>CAGAGCAGTCGTCCAGGGAAAGGACGAAGAAGACTGGCAGCTGATCGACGACTCGTT-<br>CAACTTCAAGTTCTCGCTGCACCCGAACGACCTGGT<br>CGAAGTCATCACAAAGAAGGCAAGAATGTTCGGATACTTCGCATCGTGCCACAGAG-<br>GAACAGGAAACATCAACATCAGAATCCACGACCTGGA<br>CCACAAGATCGGAAAGAACGGAATCCTGGAAGGAATCGGAGTCAA-<br>GACAGCACTGTCGTTCCAGAAGTACCAGATCGACGAACTGGGAAAGGA<br>AATCAGACCGTGCAGACTGAAGAAGAGACCGCCGGTCAGATCCGGAAAGAGAACAGCA-<br>GACGGATCGGAATTCGAATCGCCGAAGAAGAGAG<br>AAAGGTCGAATGATAGCTAGCTCGAGTCTAGAGGGCCCGTTTAAACCCGCT-<br>GATCAGCCTCGACTGTGCCTTCTAGTTGCCAGCCATCTGTTG<br>TTTGCCCCTCCCCCGTGCCTTCCTTGACCCTGGAAGGTGCCACTCC-<br>CACTGTCCTTTCCTAATAAAATGAGGAAATTGCATCGCATTGTCTGA<br>GTAGGTGTCATTCTATTCTGGGGGGTGGGGTGGGCAGGACAGCAAGGGGGAGGATTGG-<br>GAAGACAATAGCAGGCATGCTGGGGATGCGGTGG<br>GCTCTATGG | |
| Amino acid sequence of Neisseria meningitidis Cas9 | MAAFKPNSINYILGLDIGIASVGWAMVEIDEEENPIRLIDLGVRVFERAEVPKTGDSLA-<br>MARRLARSVRRLTRRRAHRLLRTRRLLKREGVLQ<br>AANFDENGLIKSLPNTPWQLRAAALDRKLTPLEWSAVLLHLIKHRGYLSQRKNEGETAD-<br>KELGALLKGVAGNAHALQTGDFRTPAELALNKFE<br>KESGHIRNQRSDYSHTFSRKDLQAELILLFEKQKEFGNPHVSGGLKEGIETLLMTQR-<br>PALSGDAVQKMLGHCTFEPAEPKAAKNTYTAERFIW<br>LTKLNNLRILEQGSERPLTDTERATLMDEPYRKSKLTYAQARKLLGLEDTAFFKGL-<br>RYGKDNAEASTLMEMKAYHAISRALEKEGLKDKKSPL<br>NLSPELQDEIGTAFSLEKTDEDITGRLKDRIQPEILEALLKHISFDKFVQISLKALR-<br>RIVPLMEQGKRYDEACAEIYGDHYGKKNTEEKIYLP<br>PIPADEIRNPVVLRALSQARKVINGVVRRYGSPARIHI-<br>ETAREVGKSFKDRKEIEKRQEENRKDREKAAAKFREYFPNFVGEPKSKDILKLRL<br>YEQQHGKCLYSGKEINLGRLNEKGYVEIDHALPFSRTWDD-<br>SENNKVLVLGSENQNKGNQTPYEYFNGKDNSREWQEFKARVETSRFPRSKKQR<br>ILLQKFDEDGFKERNLNDTRYVNRFLCQF-<br>VADRMRLTGKGKKRVFASNGQITNLLRGFWGLRKVRAENDRHHALDAVVVACSTVAMQQKITRF<br>VRYKEMNAFDGKTIDKETGEVLHQKTHFPQPWEFFAQEVMIRVFGKPDGKPEFEE-<br>ADTLEKLRTLLAEKLSSRPEAVHEYVTPLFVSRAPNRK<br>MSGQGHMETVKSAKRLDEGVSVLRVPLTQLKLKDLEKMVNREREPKLYEALKARLE-<br>AHKDDPAKAFAEPFYKYDKAGNRTQQVKAVRVEQVQK<br>TGVWVRNHNGIADNATMVRVDVFEKGDKYYLVPIYSWQVAKGIL-<br>PDRAVVQGKDEEDWQLIDDSFNFKFSLHPNDLVEVITKKARMFGYFASC<br>HRGTGNINIRIHDLDHKIGKNGILEGIGVKTALSFQKYQIDELGKEIRPCRLKKRPPVRSGKRTADGSEFESPKKKRKVE | 68 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| G390 guide RNA | mG*mC*mC*GAGUCUGGAGAGCUGCAGUUUUAGAmGmCmUmAmGmAmAmAmUmAmGmCAAGUUAAAAUAAGGCUAGUCCGUUAUCAmAmCmUm UmGmAmAmAmAmAmGmUmGmGmCmAmCmCmGmAmGmUmCmGmGmUmGmCmU*mU*mU*mU | 69 |
| G502 guide RNA | mA*mC*mA*CAAAUACCAGUCCAGCGGUUUUAGAmGmCmUmAmGmAmAmAmUmAmGmCAAGUUAAAAUAAGGCUAGUCCGUUAUCAmAmCmUm UmGmAmAmAmAmAmGmUmGmGmCmAmCmCmGmAmGmUmCmGmGmUmGmCmU*mU*mU*mU | 70 |
| G509 guide RNA | mA*mA*mA*GUUCUAGAUGCCGUCCGGUUUUAGAmGmCmUmAmGmAmAmAmUmAmGmCAAGUUAAAAUAAGGCUAGUCCGUUAUCAmAmCmUm UmGmAmAmAmAmAmGmUmGmGmCmAmCmCmGmAmGmUmCmGmGmUmGmCmU*mU*mU*mU | 71 |
| G534 guide RNA | mA*mC*mG*CAAAUAUCAGUCCAGCGGUUUUAGAmGmCmUmAmGmAmAmAmUmAmGmCAAGUUAAAAUAAGGCUAGUCCGUUAUCAmAmCmUm UmGmAmAmAmAmAmGmUmGmGmCmAmCmCmGmAmGmUmCmGmGmUmGmCmU*mU*mU*mU | 72 |
| DNA coding sequence of eGFP | TCGCGCGTTTCGGTGATGACGGTGAAAACCTCTGACACATGCAGCTCCCGGAGACGGT-CACAGCTTGTCTGTAAGCGGATGCCGGGAGCAGAC AAGCCCGTCAGGGCGCGTCAGCGGGTGTTGGCGGGTGTCGGGGCTGGCTTAACTATGCGG-CATCAGAGCAGATTGTACTGAGAGTGCACCATA TGCGGTGTGAAATACCGCACAGATGCGTAAGGAGAAAATACCGCATCAGGCGCCATTCGC-CATTCAGGCTGCGCAACTGTTGGGAAGGGCGAT CGGTGCGGGCCTCTTCGCTATTACGCCAGCTGGCGAAAGGGGGATGTGCTGCAAGGCGAT-TAAGTTGGGTAACGCCAGGGTTTTCCCAGTCAC GACGTTGTAAAACGACGGCCAGTGAATTCTAATACGACTCAC-TATAGGGTCCCGCAGTCGGCGTCCAGCGGCTCTGCTTGTTCGTGTGTGTGT CGTTGCAGGCCTTATTCGGATCCATGGTGAGCAAGGGCGAGGAGCTGTT-CACCGGGGTGGTGCCCATCCTGGTCGAGCTGGACGGCGACGTAA ACGGCCACAAGTTCAGCGTGTCCGGCGAGGGCGAGGGCGATGCCACC-TACGGCAAGCTGACCCTGAAGTTCATCTGCACCACCGGCAAGCTGC CCGTGCCCTGGCCCACCCTCGTGACCACCCTGACCTACGGCGTGCAGTGCTTCAGCCGC-TACCCCGACCACATGAAGCAGCACGACTTCTTCA AGTCCGCCATGCCCGAAGGCTACGTCCAGGAGCGCACCATCTTCTT-CAAGGACGACGGCAACTACAAGACCCGCGCCGAGGTGAAGTTCGAGG GCGACACCCTGGTGAACCGCATCGAGCTGAAGGGCATCGACTTCAAGGAGGACGGCAA-CATCCTGGGGCACAAGCTGGAGTACAACTACAACA GCCACAACGTCTATATCATGGCCGACAAGCAGAAGAACGGCATCAAGGTGAACTTCAA-GATCCGCCACAACATCGAGGACGGCAGCGTGCAGC TCGCCGACCACTACCAGCAGAACACCCC-CATCGGCGACGCCCCGTGCTGCTGCCCGACAACCACTACCTGAGCACCCAGTCCGCCCTGAGCA AAGACCCCAACGAGAAGCGCGATCACATGGTCCTGCTGGAGTTCGTGACCGCCGCCGG-GATCACTCTCGGCATGGACGAGCTGTACAAGTAAT AGGAATTATGCAGTCTAGCCATCACATTTAAAAGCATCTCAGCCTACCAT-GAGAATAAGAGAAAGAAAATGAAGATCAATAGCTTATTCATCT CTTTTTCTTTTTCGTTGGTGTAAAGCCAACACCCTGTCTAAAAAACATAAATTTCTT-TAATCATTTTGCCTCTTTTCTCTGTGCTTCAATTAA TAAAAAATG-GAAAGAACCTCGAGAAAAAAAAAAAAAAAAAAAAAAAAAAAAAAAAAAAAAAAAAAAAAAAAAAAAAAAAAAAAAAAA AAAAAAAAAAAAAAAAAAAAAAAAAAAATCTAGACTTAAGCTTGAT-GAGCTCTAGCTTGGCGTAATCATGGTCATAGCTGTTTCCTGTGTG AAATTGTTATCCGCTCACAATTCCACACAACATACGAGCCGGAAGCAT-AAAGTGTAAAGCCTGGGGTGCCTAATGAGTGAGCTAACTCACATT AATTGCGTTGCGCTCACTGCCCGCTTTCCAGTCGGGAAACCTGTCGTGCCAGCTGCAT-TAATGAATCGGCCAACGCGCGGGGAGAGGCGGTTT GCGTATTGGGCGCTCTTCCGCTTCCTCGCT-CACTGACTCGCTGCGCTCGGTCGTTCGGCTGCGGCGAGCGGTATCAGCTCACTCAAAGGCGGT AATACGGTTATCCACAGAATCAGGGGATAACGCAGGAAAGAACATGT-GAGCAAAAGGCCAGCAAAAGGCCAGGAACCGTAAAAAGGCCGCGTT GCTGGCGTTTTTCCATAGGCTCCGCCCCCCTGACGAGCATCACAAAAATCGACGCT-CAAGTCAGAGGTGGCGAAACCCGACAGGACTATAAAG ATACCAGGCGTTTCCCCCTGGAAGCTCCCTCGTGCGCTCTCCTGTTCCGACCCTGCCGCT-TACCGGATACCTGTCCGCCTTTCTCCCTTCGGG AAGCGTGGCGCTTTCTCATAGCT-CACGCTGTAGGTATCTCAGTTCGGTGTAGGTCGTTCGCTCCAAGCTGGGCTGTGTGCACGAACCCCCCGT TCAGCCCGACCGCTGCGCCTTATCCGGTAACTATCGTCTTGAGTCCAACCCGGTAA-GACACGACTTATCGCCACTGGCAGCAGCCACTGGTAA CAGGATTAGCAGAGCGAGGTATGTAGGCGGTGCTACAGAGTTCTT-GAAGTGGTGGCCTAACTACGGCTACACTAGAAGAACAGTATTTGGTAT CTGCGCTCTGCTGAAGCCAGTTACCTTCGGAAAAAGAGTTGGTAGCTCTT-GATCCGGCAAACAAACCACCGCTGGTAGCGGTGGTTTTTTTGT TTGCAAGCAGCAGATTACGCGCAGAAAAAAAGGATCTCAAGAAGATCCTTTGATCTTTTC-TACGGGGTCTGACGCTCAGTGGAACGAAAACTC ACGTTAAGGGATTTTGGTCATGAGATTATCAAAAGGATCTTCACCTAGATCCTTT-TAAATTAAAAATGAAGTTTTAAATCAATCTAAAGTAT ATATGAGTAAACTTGGTCTGACAGTTACCAATGCTTAATCAGTGAGGCACCTATCTCAGC-GATCTGTCTATTTCGTTCATCCATAGTTGCCTG ACTCCCCGTCGTGTAGATAACTACGATACGGGAGGGCTTAC-CATCTGGCCCCAGTGCTGCAATGATACCGCGAGACCCACGCTCACCGGCTCC | 73 |

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | AGATTTATCAGCAATAAACCAGCCAGCCG-GAAGGGCCGAGCGCAGAAGTGGTCCTGCAACTTTATCCGCCTCCATCCAGTCTATTAATTGTTGCCGGGAAGCTAGAGTAAGTAGTTCGCCAGTTAATAGTTTGCGCAACGTTGTTGCCATTGC-TACAGGCATCGTGGTGTCACGCTCGTCGTTTGG TATGGCTTCATTCAGCTCCGGTTCCCAACGATCAAGGCGAGTTACATGATCCCC-CATGTTGTGCAAAAAAGCGGTTAGCTCCTTCGGTCCTCC GATCGTTGTCAGAAGTAAGTTGGCCGCAGTGTTATCACTCATGGTTATGGCAGCACTG-CATAATTCTCTTACTGTCATGCCATCCGTAAGATG CTTTTCTGTGACTGGTGAGTACTCAACCAAGTCATTCT-GAGAATAGTGTATGCGGCGACCGAGTTGCTCTTGCCCGGCGTCAATACGGGATAA TACCGCGCCACATAGCAGAACTTTAAAAGTGCTCATCATTG-GAAAACGTTCTTCGGGGCGAAAACTCTCAAGGATCTTACCGCTGTTGAGATC CAGTTCGATGTAACCCACTCGTGCACCCAACTGATCTTCAGCATCTTTTACTTT-CACCAGCGTTTCTGGGTGAGCAAAAACAGGAAGGCAAAA TGCCGCAAAAAAGGGAATAAGGGCGACACGGAAATGTTGAATACTCAT-ACTCTTCCTTTTTCAATATTATTGAAGCATTTATCAGGGTTATTG TCTCATGAGCGGATACATATTTGAATGTATT-TAGAAAAATAAACAAATAGGGGTTCCGCGCACATTTCCCCGAAAAGTGCCACCTGACGTCTA AGAAACCATTATTATCATGACATTAACCTATAAAAATAGGCGTATCACGAGGCCCTTTCGTCG | |
| Modified sgRNA pattern, where N are nucleotides encoding a guide sequence | mN*mN*mN*NNNNNNNNNNNNNNNNNNNGUUUUAG AmGmCmUmAmGmAmAmAmUmAmGmCAAGUUAAA AUAAGGCUAGUCCGUUAUCAmAmCmUmUmGmAm AmAmAmAmGmUmGmGmCmAmCmCmGmAmGmUmC mGmGmUmGmCmU*mU*mU*mU | 74 |
| CMV-1 5' UTR | CAGATCGCCTGGAGACGCCATCCACGCTGTTTTGACCTCCAT | 75 |
| CMV-2 5' UTR | AGAAGACACCGGGACCGATCCAGCCTCCGCGGCCGGGAACGG | 76 |
| CMV-3 5' UTR | TGCATTGGAACGCGGATTCCCCGTGCCAAGAGTGACTCACCG | 77 |
| SV40 NLS | PKKKRKV | 78 |
| Exemplary NLS 1 | LAAKRSRTT | 79 |
| Exemplary NLS 2 | QAAKRSRTT | 80 |
| Exemplary NLS 3 | PAPAKRERTT | 81 |
| Exemplary NLS 4 | QAAKRPRTT | 82 |
| Exemplary NLS 5 | RAAKRPRTT | 83 |
| Exemplary NLS 6 | AAAKRSWSMAA | 84 |
| Exemplary NLS 7 | AAAKRVWSMAF | 85 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| Exemplary NLS 8 | AAAKRSWSMAF | 86 |
| Exemplary NLS 9 | AAAKRKYFAA | 87 |
| Exemplary NLS 10 | RAAKRKAFAA | 88 |
| Exemplary NLS 11 | RAAKRKYFAV | 89 |
| Alternate SV40 NLS | PKKKRRV | 90 |
| Nucleoplasmin NLS | KRPAATKKAGQAKKKK | 91 |
| Exemplary coding sequence for SV40 NLS | CCGAAGAAGAAGAGAAAGGTC | 92 |
| Exemplary coding sequence for NLS1 | CTGGCAGCAAAGAGAAGCAGAACAACA | 93 |
| Exemplary coding sequence for NLS2 | CAGGCAGCAAAGAGAAGCAGAACAACA | 94 |
| Exemplary coding sequence for NLS3 | CCGGCACCGGCAAAGAGAGAAAGAACAACA | 95 |
| Exemplary coding sequence for NLS4 | CAGGCAGCAAAGAGACCGAGAACAACA | 96 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
| --- | --- | --- |
| Exemplary coding sequence for NLS5 | AGAGCAGCAAAGAGACCGAGAACAACA | 97 |
| Exemplary coding sequence for NLS6 | GCAGCAGCAAAGAGAAGCTGGAGCATGGCAGCA | 98 |
| Exemplary coding sequence for NLS7 | GCAGCAGCAAAGAGAGTCTGGAGCATGGCATTC | 99 |
| Exemplary coding sequence for NLS8 | GCAGCAGCAAAGAGAAGCTGGAGCATGGCATTC | 100 |
| Exemplary coding sequence for NLS9 | GCAGCAGCAAAGAGAAAGTACTTCGCAGCA | 101 |
| Exemplary coding sequence for NLS10 | AGAGCAGCAAAGAGAAAGGCATTCGCAGCA | 102 |
| Exemplary coding sequence for NLS11 | AGAGCAGCAAAGAGAAAGTACTTCGCAGTC | 103 |
| Exemplary coding sequence for alternate SV40 NLS | CCGAAGAAGAAGAGAAGAGTC | 104 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| exemplary Kozak sequence | gccgccRccAUGG | 105 |
| | Not Used | 106 |
| Cas9 ORF using long half life codons of Table 4, with start and stop codons | ATGGACAAGAAGTACTCTATCGGTTTGGACATCGGTACCAACTCTGTCGGTTGGGCCGT-CATCACCGACGAATACAAGGTCCCATCTAAGAAGT<br>TCAAGGTCTTGGGTAACACCGACAGACACTCTATCAAGAAGAACTT-GATCGGTGCCTTGTTGTTCGACTCTGGTGAAACCGCCGAAGCCACCAG<br>ATTGAAGAGAACCGCCAGAAGAAGATACACCAGAAGAAAGAACAGAATCTGC-TACTTGCAAGAAATCTTCTCTAACGAAATGGCCAAGGTCGAC<br>GACTCTTTCTTCCACAGATTGGAAGAATCTTTCTTGGTCGAAGAA-GACAAGAAGCACGAAAGACACCCAATCTTCGGTAACATCGTCGACGAAG<br>TCGCCTACCACGAAAAGTACCCAACCATCTACCACTTGAGAAAGAAGTTGGTCGACTC-TACCGACAAGGCCGACTTGAGATTGATCTACTTGGC<br>CTTGGCCCACATGATCAAGTTCAGAGGTCACTTCTTGATCGAAGGTGACTTGAACCCA-GACAACTCTGACGTCGACAAGTTGTTCATCCAATTG<br>GTCCAAACCTACAACCAATTGTTCGAAGAAAACCCAATCAACGCCTCTGGTGTCGACGC-CAAGGCCATCTTGTCTGCCAGATTGTCTAAGAGCA<br>GAAGATTGGAAAACTTGATCGCCCAATTGCCAGGT-GAAAAGAAGAACCGGTTTGTTCGGTAACTTGATCGCCTTGTCTTTGGGTTTGACCCCAAA<br>CTTCAAGTCTAACTTCGACTTGGCCGAAGACGCCAAGTTGCAATTGTCTAAGGACACC-TACGACGACGACTTGGACAACTTGTTGGCCCAAATC<br>GGTGACCAATACGCCGACTTGTTCTTGGCCGCCAAGAACTTGTCTGACGC-CATCTTGTTGTCTGACATCTTGAGAGTCAACACCGAAATCACCA<br>AGGCCCCATTGTCTGCCTCTATGATCAAGAGATACGACGAACACCACCAA-GACTTGACCTTGTTGAAGGCCTTGGTCAGACAACAATTGCCAGA<br>AAAGTACAAGGAAATCTTCTTCGACCAATCTAAGAACGGTTACGCCGGTTA-CATCGACGGTGGTGCCTCTCAAGAAGAATTCTACAAGTTCATC<br>AAGCCAATCTTGGAAAAGATGGACGGTACCGAAGAATTGTTGGTCAAGTTGAACAGAGAA-GACTTGTTGAGAAAGCAAAGAACCTTCGACAACG<br>GTTCTATCCCACACCAAATCCACTTGGGTGAATTGCACGCCATCTTGAGAAGACAAGAA-GACTTCTACCCATTCTTGAAGGACAACAGAGAAAA<br>GATCGAAAAGATCTTGACCTTCAGAATCCCATACTACGTCGGTCCAT-TGGCCAGAGGTAACAGCAGATTCGCCTGGATGACCAGAAAGTCTGAA<br>GAAACCATCACCCCATGGAACTTCGAAGAAGTCGTCGACAAGGGTGCCTCTGCC-CAATCTTTCATCGAAAGAATGACCAACTTCGACAAGAACT<br>TGCCAAACGAAAAGGTCTTGCCAAAGCACTCTTTTGTTGTACGAATACTTCACCGTCTA-CAACGAATTGACCAAGGTCAAGTACGTCACCGAAGG<br>TATGAGAAAGCCAGCCTTCTTGTCTGGTGAACAAAAGAAGGCCATCGTCGACTTGTTGTT-CAAGACCAACAGAAAGGTCACCGTCAAGCAATTG<br>AAGGAAGACTACTTCAAGAAGATCGAATGCTTCGACTCTGTCGAAATCTCTGGTGTCGAA-GACAGATTCAACGCCTCTTTGGGTACCTACCACG<br>ACTTGTTGAAGATCATCAAGGACAAGGACTTCTTGGACAACGAAGAAAACGAAGA-CATCTTGGAAGACATCGTCTTGACCTTGACCTTGTTCGA<br>AGACAGAGAAATGATCGAAGAAAGATTGAAGACCTACGCCCCACTTGTTCGACGACAAGGT-CATGAAGCAATTGAAGAGAAGAAGATACACCGGT<br>TGGGGTAGATTGAGCAGAAAGTTGATCAACGGTATCAGAGACAAGCAATCTGGTAAGAC-CATCTTGGACTTCTTGAAGTCTGACGGTTTCGCCA<br>ACAGAAACTTCATGCAATTGATCCACGACGACTCTTTGACCTTCAAGGAAGACATC-CAAAAGGCCCAAGTCTCTGGTCAAGGTGACTCTTTGCA<br>CGAACACATCGCCAACTTGGCCGGTTCTCCAGCCATCAAGAAGGGTATCTTGCAAACCGT-CAAGGTCGTCGACGAATTGGTCAAGGTCATGGGT<br>AGACACAAGCCAGAAAACATCGTCATCGAAATGGCCAGAGAAAACCAAACCACC-CAAAAGGGTCAAAAGAACAGCAGAGAAAGAATGAAGAGAA<br>TCGAAGAAGGTATCAAGGAATTGGGTTCTCAAATCTT-GAAGGAACACCCAGTCGAAAACACCCAATTGCAAACGAAAAGTTGTACTTGTACTA<br>CTTGCAAAACGGTAGAGACATGTACGTCGACCAAGAATTGGACATCAACAGAT-TGTCTGACTACGACGTCGACCACATCGTCCCACAATCTTTC<br>TTGAAGGACGACTCTATCGACAACAAGGTCTTGACCA-GATCTGACAAGAACAGAGGTAAGTCTGACAACGTCCCATCTGAAGAAGTCGTCAAGA<br>AGATGAAGAACTACTGGAGACAATTGTTGAACGCCAAGTTGATCACC-CAAAGAAAGTTCGACAACTTGACCAAGGCCGAAAGAGGTGGTTTGTC<br>TGAATTGGACAAGGCCGGTTTCATCAAGAGACAATTGGTCGAAACCAGACAAATCAC-CAAGCACGTCGCCCAAATCTTGGACAGCAGAATGAAC<br>ACCAAGTACGACGAAAACGACAAGTTGATCAGAGAAGTCAAGGTCATCACCTT-GAAGTCTAAGTTGGTCTCTGACTTCAGAAAGGACTTCCAAT<br>TCTACAAGGTCAGAGAAATCAACAACTACCACCACGCCCACGACGCCTACTT-GAACGCCGTCGTCGGTACCGCCTTGATCAAGAAGTACCCAAA<br>GTTGGAATCTGAATTCGTCTACGGTGACTACAAGGTCTACGACGTCAGAAAGATGATCGC-CAAGTCTGAACAAGAAATCGGTAAGGCCACCGCC | 107 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
|  | AAGTACTTCTTCTACTCTAACATCATGAACTTCTTCAAGACCGAAATCACCTTGGC-CAACGGTGAAATCAGAAAGAGACCATTGATCGAAACCA ACGGTGAAACCGGTGAAATCGTCTGGGACAAGGGTAGAGACTTCGC-CACCGTCAGAAAGGTCTTGTCTATGCCACAAGTCAACATCGTCAAGAA GACCGAAGTCCAAACCGGTGGTTTCTCTAAGGAATCTATCTTGC-CAAAGAGAAACTCTGACAAGTTGATCGCCAGAAAGAAGGACTGGGACCCA AAGAAGTACGGTGGTTTCGACTCTCCAACCGTCGCCTACTCTGTCTTGGTCGTCGC-CAAGGTCGAAAAGGGTAAGTCTAAGAAGTTGAAGTCTG TCAAGGAATTGTTGGGTATCACCATCATGGAAAGATCTTCTTTCGAAAAGAACC-CAATCGACTTCTTGGAAGCCAAGGGTTACAAGGAAGTCAA GAAGGACTTGATCATCAAGTTGCCAAAGTACTCTTTGTTCGAATTG-GAAAACGGTAGAAAGAGAATGTTGGCCTCTGCCGGTGAATTGCAAAAG GGTAACGAATTGGCCTTGCCATCTAAGTACGTCAACTTCTTGTACTTGGCCTCTCAC-TACGAAAAGTTGAAGGGTTCTCCAGAAGACAACGAAC AAAAGCAATTGTTCGTCGAACAACACAAGCACTACTTGGACGAAAT-CATCGAACAAATCTCTGAATTCTCTAAGGAGTCATCTTGGCCGACGC CAACTTGGACAAGGTCTTGTCTGCCTACAACAAGCACAGAGACAAGC-CAATCAGAGAACAAGCCGAAAACATCATCCACTTGTTCACCTTGACC AACTTGGGTGCCCCAGCCGCCTTCAAGTACTTCGACACCACCATCGACAGAAAGAGATA-CACCTCTACCAAGGAAGTCTTGGACGCCACCTTGA TCCACCAATCTATCACCGGTTTGTACGAAACCAGAATCGACTTGTCTCAAT-TGGGTGGTGACGGTGGTGGTTCTCCAAAGAAGAAGAGAAAGGT CTAA |  |
| Cas9 ORF using U rich codons of Table 4, with start and stop codons | ATGGATAAAAAATATTCTATTGGTTTAGATATTGGTACTAATTCTGTTGGTTGGGCTGTT-ATTACTGATGAATATAAAGTTCCTTCTAAAAAAT TTAAAGTTTTAGGTAATACTGATCGTCATTCTATTAAAAAAAATTTAATTGGTGCTTTAT-TATTTGATTCTGGTGAAACTGCTGAAGCTACTCG TTTAAAACGTACTGCTCGTCGTCGTTATACTCGTCGTAAAAATCGTATTTGTTATTTA-CAAGAAATTTTTTCTAATGAAATGGCTAAAGTTGAT GATTCTTTTTTTCATCGTTTAGAAGAATCTTTTTTAGTTGAAGAAGATAAAAAACAT-GAACGTCATCCTATTTTTGGTAATATTGTTGATGAAG TTGCTTATCATGAAAAATATCCTACTATTTATCATTTACGTAAAAAATTAGTTGATTC-TACTGATAAAGCTGATTTACGTTTAATTTATTTAGC TTTAGCTCATATGATTAAATTTCGTGGTCATTTTTTAATTGAAGGTGATTTAAATCCTGA-TAATTCTGATGTTGATAAATTATTTATTCAATTA GTTCAAACTTATAATCAATTATTTGAAGAAAATCCTATTAATGCTTCTGGTGTT-GATGCTAAAGCTATTTTATCTGCTCGTTTATCTAAATCTC GTCGTTTAGAAAATTTAATTGCTCAATTACCTGGTGAAAAAAAAAATGGTTTAT-TTGGTAATTTAATTGCTTTATCTTTAGGTTTAACTCCTAA TTTTAAATCTAATTTTGATTTAGCTGAAGATGCTAAATTACAATTATCTAAAGATACT-TATGATGATGATTTAGATAATTTATTAGCTCAAATT GGTGATCAATATGCTGATTTATTTTTAGCTGCTAAAAATTTATCTGATGCTATTTTAT-TATCTGATATTTTACGTGTTAATACTGAAATTACTA AAGCTCCTTTATCTGCTTCTATGATTAAACGTTATGATGAACATCATCAAGATTTAACTT-TATTAAAAGCTTTAGTTCGTCAACAATTACCTGA AAAATATAAAGAAATTTTTTTTGATCAATCTAAAAATGGTTATGCTGGTTATATT-GATGGTGGTGCTTCTCAAGAAGAATTTTATAAATTTATT AAACCTATTTTAGAAAAAATGGATGGTACTGAAGAATTATTAGTTAAATTAAATCGTGAA-GATTTATTACGTAAACAACGTACTTTTGATAATG GTTCTATTCCTCATCAAATTCATTTAGGTGAATTACATGCTATTTTACGTCGTCAAGAA-GATTTTTATCCTTTTTTAAAAGATAATCGTGAAAA AATTGAAAAATTTTAACTTTTCGTATTCCTTATTATGTTGGTCCTT-TAGCTCGTGGTAATTCTCGTTTTGCTTGGATGACTCGTAAATCTGAA GAAACTATTACTCCTTGGAATTTTGAAGAAGTTGTTGATAAAGGTGCTTCTGCT-CAATCTTTTATTGAACGTATGACTAATTTTGATAAAAATT TACCTAATGAAAAGTTTTACCTAAACATTCTTTATTATATGAATATTTTACTGTT-TATAATGAATTAACTAAAGTTAAATATGTTACTGAAGG TATGCGTAAACCTGCTTTTTTATCTGGTGAACAAAAAAAAGCTATTGTTGATTTATTATT-TAAACTAATCGTAAAGTTACTGTTAAACAATTA AAAGAAGATTATTTTAAAAAAATTGAATGTTTTGATTCTGTTGAAATTTCTGGTGTTGAA-GATCGTTTTAATGCTTCTTTAGGTACTTATCATG ATTTATTAAAAATTATTAAAGATAAAGATTTTTTAGATAATGAAGAAATGAAGATATTT-TAGAAGATATTGTTTTAACTTTAACTTTATTTGA AGATCGTGAAATGATTGAAGAACGTTTAAAAACTTATGCTCATTTATTTGATGATAAAGT-TATGAACAATTAAAACGTCGTCGTTATACTGGT TGGGGTCGTTTATCTCGTAAATTAATTAATGGTATTCGTGATAAACAATCTGGTAAAACT-ATTTTAGATTTTTTAAAATCTGATGGTTTTGCTA ATCGTAATTTTATGCAATTAATTCATGATGATTCTTTAACTTTTAAAGAAGATATT-CAAAAAGCTCAAGTTTCTGGTCAAGGTGATTCTTTACA TGAACATATTGCTAATTTAGCTGGTTCTCCTGCTATTAAAAAAGGTATTTTACAAACTGT-TAAAGTTGTTGATGAATTAGTTAAAGTTATGGGT CGTCATAAACCTGAAAATATTGTTATTGAAATGGCTCGTGAAAATCAAACTACT-CAAAAAGGTCAAAAAAATTCTCGTGAACGTATGAAACGTA TTGAAGAAGGTATTAAAGAATTAGGTTCTCAAATTTTAAAAGAACATCCTGTT-GAAAATACTCAATTACAAAATGAAAAATTATATTTATATTA | 108 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | TTTACAAAATGGTCGTGATATGTATGTTGATCAAGAATTAGATATTAATCGTTTATCT-GATTATGATGTTGATCATATTGTTCCTCAATCTTTT TTAAAAGATGATTCTATTGATAATAAAGTTTTAACTCGTTCTGA-TAAAAATCGTGGTAAATCTGATAATGTTCCTTCTGAAGAAGTTGTTAAAA AAATGAAAAATTATTGGCGTCAATTATTAAATGCTAAATTAATTACTCAACGTAAATTT-GATAATTTAACTAAAGCTGAACGTGGTGGTTTATC TGAATTAGATAAAGCTGGTTTTATTAAACGTCAATTAGTTGAAACTCGTCAAAT-TACTAAACATGTTGCTCAAATTTTAGATTCTCGTATGAAT ACTAAATATGATGAAAATGATAAATTAATTCGTGAAGTTAAAGTTATTACTT-TAAAAATCTAAATTAGTTTCTGATTTTCGTAAAGATTTTCAAT TTTATAAAGTTCGTGAAATTAATAATTATCATCATGCTCATGATGCTTATT-TAAATGCTGTTGTTGGTACTGCTTTAATTAAAAAATATCCTAA ATTAGAATCTGAATTTGTTTATGGTGATTATAAAGTTTATGATGTTCGTAAAATGAT-TGCTAAATCTGAACAAGAAATTGGTAAAGCTACTGCT AAATATTTTTTTATTCTAATATTATGAATTTTTTAAAACTGAAATTACTT-TAGCTAATGGTGAAATTCGTAAACGTCCTTTAATTGAAACTA ATGGTGAAACTGGTGAAATTGTTTGGGATAAAGGTCGTGATTTTGC-TACTGTTCGTAAAGTTTTATCTATGCCTCAAGTTAATATTGTTAAAAA AACTGAAGTTCAAACTGGTGGTTTTTCTAAAGAATCTATTTTACCTAAACGTAATTCTGA-TAAATTAATTGCTCGTAAAAAAGATTGGGATCCT AAAAAATATGGTGGTTTTGATTCTCCTACTGTTGCTTATTCTGTTT-TAGTTGTTGCTAAAGTTGAAAAAGGTAAATCTAAAAAATTAAAATCTG TTAAAGAATTATTAGGTATTACTATTATGGAACGTTCTTCTTTTGAAAAAAATCCTATT-GATTTTTTAGAAGCTAAAGGTTATAAAGAAGTTAA AAAAGATTTAATTATTAAATTACCTAAATATTCTTTATTTGAATT-AGAAAATGGTCGTAAACGTATGTTAGCTTCTGCTGGTGAATTACAAAAA GGTAATGAATTAGCTTTACCTTCTAAATATGTTAATTTTTTATATTTAGCTTCTCATTAT-GAAAAATTAAAAGGTTCTCCTGAAGATAATGAAC AAAAACAATTATTTGTTGAACAACATAAACATTATTTAGATGAAATTATTGAACAAAT-TTCTGAATTTTCTAAACGTGTTATTTTAGCTGATGC TAATTTAGATAAAGTTTTATCTGCTTATAATAAACATCGTGATAAACCTATTCGT-GAACAAGCTGAAATATTATTCATTTATTTACTTTAACT AATTTAGGTGCTCCTGCTGCTTTTAAATATTTTGATACTACTATTGATCGTAAACGT-TATACTTCTACTAAAGAAGTTTTAGATGCTACTTTAA TTCATCAATCTATTACTGGTTTATATGAAACTCGTATTGATTTATCTCAATTAGGTGGT-GATGGTGGTGGTTCTCCTAAAAAAAAACGTAAAGT TTGA | |
| Cas9 ORF using low G codons of Table 4, with start and stop codons | ATGGACAAAAAATACTCCATCGGCCTCGACATCGGCACCAACTCCGTCGGCTGGGCCGT-CATCACCGACGAATACAAAGTCCCCTCCAAAAAAT TCAAAGTCCTCGGCAACACCGACAGACACTCCATCAAAAAAAACCT-CATCGGCGCCCTCCTCTTCGACTCCGGCGAAACCGCCGAAGCCACCAG ACTCAAAAGAACCGCCAGAAGAAGATACACCAGAAGAAAAAACAGAATCTGCTACCTC-CAAGAAATCTTCTCCAACGAAATGGCCAAAGTCGAC GACTCCTTCTTCCACAGACTGAAGAATCCTTCCTCGTCGAAGAA-GACAAAAACACGAAAGACACCCCATCTTCGGCAACATCGTCGACGAAG TCGCCTACCACGAAAAATACCCCACCATCTACCACCTCAGAAAAAAACTCGTCGACTC-CACCGACAAAGCCGACCTCAGACTCATCTACCTCGC CCTCGCCCACATGATCAAATTCAGAGGCCACTTCCTCATCGAAGGCGACCT-CAACCCCGACAACTCCGACGTCGACAAACTCTTCATCCAACTC GTCCAAACCTACAACCAACTCTTCGAAGAAAACCCCATCAACGCCCTCCGGCGTCGACGC-CAAAGCCATCCTCTCCGCCAGACTCTCCAAATCCA GAAGACTCGAAACCCTCATCGCC-CAACTCCCCGGCGAAAAAAAAACGGCCTCTTCGGCAACCTCATCGCCCTCTCCCTCGGCCTCACCCCCAA CTTCAAATCCAACTTCGACCTCGCCGAAGACGCCAAACTCCAACTCTCCAAAGACACC-TACGACGACGACCTCGACAACCTCCTCGCCCAAATC GGCGACCAATACGCCGACCTCTTCCTCGCCGCCAAAAACCTCTCCGACGC-CATCCTCCTCTCCGACATCCTCAGAGTCAACACCGAAATCACCA AAGCCCCCCTCTCCGCCTCCATGATCAAAAGATACGACGAACACCACCAAGACCT-CACCCTCCTCAAAGCCCTCGTCAGACAACAACTCCCCGA AAAATACAAAGAAATCTTCTTCGACCAATCCAAAAACGGCTACGCCGGCTA-CATCGACGGCGGCGCCTCCCAAGAAGAATTCTACAAATTCATC AAACCCATCCTCGAAAAAATGGACGGCACCGAAGAACTCCTCGTCAAACTCAACAGAGAA-GACCTCCTCAGAAAACAAAGAACCTTCGACAACG GCTCCATCCCCCACCAAATCCACCTCGGCGAACTCCACGCCATCCTCAGAAGACAAGAA-GACTTCTACCCCTTCCTCAAAGACAACAGAGAAAA AATCGAAAAAATTCCTCACCTTCAGAATCCCCTAC-TACGTCGGCCCCCTCGCCAGAGGCAACTCCAGATTCGCCTGGATGACCAGAAAATCCGAA GAAACCATCACCCCCTGGAACTTCGAAGAAGTCGTCGACAAAGGCGCCTCCGCC-CAATCCTTCATCGAAAGAATGACCAACTTCGACAAAAACC TCCCCAACGAAAAGTCCTCCCCCAAACACTCCCTCCTCTACGAATACTTCACCGTCTA-CAACGAACTCACCAAAGTCAAATACGTCACCGAAGG CATGAGAAAACCCGCCTTCCTCTCCGGCGAACAAAAAAAGCCATCGTCGACCTCCTCTT-CAAAACCAACAGAAAAGTCACCGTCAAACAACTC AAAGAAGACTACTTCAAAAAATCGAATGCTTCGACTCCGTCGAAATCTCCGGCGTCGAA-GACAGATTCAACGCCTCCCTCGGCACCTACCACG | 109 |

| Description | Sequence | SEQ ID No. |
|---|---|---|
| | ACCTCCTCAAAATCATCAAAGACAAAGACTTCCTCGACAACGAAGAAAACGAAGA-<br>CATCCTCGAAGACATCGTCCTCACCCTCACCCTCTTCGA<br>AGACAGAGAAATGATCGAAGAAAGACTCAAAACCTACGCCCACCTCTTCGACGACAAAGT-<br>CATGAAACAACTCAAAAGAAGAAGATACACCGGC<br>TGGGGCAGACTCTCCAGAAAACTCATCAACGGCATCAGAGACAAACAATCCGGCAAAAC-<br>CATCCTCGACTTCCTCAAATCCGACGGCTTCGCCA<br>ACAGAAACTTCATGCAACTCATCCACGACGACTCCCTCACCTTCAAAGAAGACATC-<br>CAAAAAGCCCAAGTCTCCGGCCAAGGCGACTCCCTCCA<br>CGAACACATCGCCAACCTCGCCGGCTCCCCCGCCATCAAAAAAGGCATCCTCCAAACCGT-<br>CAAAGTCGTCGACGAACTCGTCAAAGTCATGGGC<br>AGACACAAACCCGAAAACATCGTCATCGAAATGGCCAGAGAAAACCAAACCACC-<br>CAAAAAGGCCAAAAAAACTCCAGAGAAAGAATGAAAAGAA<br>TCGAAGAAGGCATCAAAGAACTCGGCTCCCAAATCCT-<br>CAAAGAACACCCGTCGAAAACACCCAACTCCAAAACGAAAAACTCTACCTCTACTA<br>CCTCCAAAACGGCAGAGACATGTACGTCGACCAAGAACTCGACATCAACA-<br>GACTCTCCGACTACGACGTCGACCACATCGTCCCCCAATCCTTC<br>CTCAAAGACGACTCCATCGACAACAAAGTCCTCACCA-<br>GATCCGACAAAAACAGAGGCAAATCCGACAACGTCCCCTCCGAAGAAGTCGTCAAAA<br>AAATGAAAAACTACTGGAGACAACTCCTCAACGCCAAACTCATCACCCAAAGAAAAT-<br>TCGACAACCTCACCAAAGCCGAAAGAGGCGGCCTCTC<br>CGAACTCGACAAAGCCGGCTTCATCAAAAGACAACTCGTCGAAACCAGACAAATCAC-<br>CAAACACGTCGCCCAAATCCTCGACTCCAGAATGAAC<br>ACCAAATACGACGAAAACGACAAACTCATCAGAGAAGTCAAAGTCATCACCCTCAAATC-<br>CAAACTCGTCTCCGACTTCAGAAAAGACTTCCAAT<br>TCTACAAAGTCAGAGAAATCAACAACTACCACCACGCCCACGACGCCTACCT-<br>CAACGCCGTCGTCGGCACCGCCCTCATCAAAAAATACCCCAA<br>ACTCGAATCCGAATTCGTCTACGCGACTACAAAGTCTACGACGTCAGAAAAATGATCGC-<br>CAAATCCGAACAAGAAATCGGCAAAGCCACCGCC<br>AAATACTTCTTCTACTCCAACATCATGAACTTCTTCAAAACCGAAATCACCCTCGC-<br>CAACGGCGAAATCAGAAAAAGACCCCTCATCGAAACCA<br>ACGGCGAAACCGGCGAAATCGTCTGGGACAAAGGCAGAGACTTCGC-<br>CACCGTCAGAAAAGTCCTCTCCATGCCCCAAGTCAACATCGTCAAAAA<br>AACCGAAGTCCAAACCGGCGGCTTCTCCAAAGAATCCATCCTCCC-<br>CAAAAGAAACTCCGACAAACTCATCGCCAGAAAAAAAGACTGGGACCCC<br>AAAAAATACGGCGGCTTCGACTCCCCCACCGTCGCCTACTCCGTCCTCGTCGTCGC-<br>CAAAGTCGAAAAAGGCAAATCCAAAAAACTCAAATCCG<br>TCAAAGAACTCCTCGGCATCACCATCATGGAAAGATCCTCCTTCGAAAAAAACCC-<br>CATCGACTTCCTCGAAGCCAAAGGCTACAAAGAAGTCAA<br>AAAAGACCTCATCATCAAACTCCC-<br>CAAATACTCCCTCTTCGAACTCGAAAACGGCAGAAAAAGAATGCTCGCCTCCGCCGGCGAACTCCAAAAA<br>GGCAACGAACTCGCCCTCCCCTCCAAATACGTCAACTTCCTCTACCTCGCCTCCCAC-<br>TACGAAAAACTCAAAGGCTCCCCCGAAGACAACGAAC<br>AAAAACAACTCTTCGTCGAACAACACAAACACTACCTCGACGAAAT-<br>CATCGAACAAATCTCCGAATTCTCCAAAAGAGTCATCCTCGCCGACGC<br>CAACCTCGACAAAGTCCTCTCCGCCTACAACAAACACAGAGACAAACC-<br>CATCAGAGAACAAGCCGAAAACATCATCCACCTCTTCACCCTCACC<br>AACCTCGGCGCCCCGCCGCCTTCAAATACTTCGACACCACCATCGACGAAAAAGATA-<br>CACCTCCACCAAAGAAGTCCTCGACGCCACCCTCA<br>TCCACCAATCCATCACCGGCCTCTACGAAACCAGAATCGACCTCTCC-<br>CAACTCGGCGGCGACGCGGCGGCTCCCCCAAAAAAAAAAGAAAAGT<br>CTGA | |
| Cas9 ORF using low C codons of Table 4, with start and stop | ATGGATAAGAAGTATAGTATTGGATTGGATATTGGAACAAATAGTGTGGGATGGGCTGT-<br>GATTACAGATGAGTATAAGGTGCCTAGTAAGAAGT<br>TTAAGGTGTTGGGAAATACAGATAGACATAGTATTAAGAAGAATTTGATTG-<br>GAGCTTTGTTGTTTGATAGTGGAGAGACAGCTGAGGCTACAAG<br>ATTGAAGAGAACAGCTAGAAGAAGATATACAAGAAGAAAGAATAGAATTTGTTAT-<br>TTGCAGGAGATTTTTAGTAATGAGATGGCTAAGGTGGAT<br>GATAGTTTTTTTCATAGATTGGAGGAGAGTTTTTTGGTGGAGGAGGATAAGAAGCAT-<br>GAGAGACATCCTATTTTTGGAAATATTGTGGATGAGG<br>TGGCTTATCATGAGAAGTATCCTACAATTTATCATTTGAGAAAGAAGTTGGTGGATAGTA-<br>CAGATAAGGCTGATTTGAGATTGATTTATTTGGC<br>TTTGGCTCATATGATTAAGTTTAGAGGACATTTTTTGATTGAGGGAGATTTGAATCCTGA-<br>TAATAGTGATGTGGATAAGTTGTTTATTCAGTTG<br>GTGCAGACATATAATCAGTTGTTTGAGGAGAATCCTATTAATGCTAGTGGAGTG-<br>GATGCTAAGGCTATTTTGAGTGCTAGATTGAGTAAGAGTA<br>GAAGATTGGAGAATTTGATTGCTCAGTTGCCTGGAGAGAAGAAGAATGGATTGTTTG-<br>GAAATTTGATTGCTTTGAGTTTGGGATTGACACCTAA<br>TTTTAAGAGTAATTTTGATTTGGCTGAGGATGCTAAGTTGCAGTTGAGTAAGGATA-<br>CATATGATGATGATTTGGATAATTTGTTGGCTCAGATT<br>GGGAGATCAGTATGCTGATTGTTTTTGGCTGCTAAGAATTTGAGTGATGCTATTTTGTT-<br>GAGTGATATTTTGAGAGTGAATACAGAGATTACAA<br>AGGCTCCTTTGAGTGCTAGTATGATTAAGAGATATGATGAGCATCATCAGGATTTGACAT-<br>TGTTGAAGGCTTTGGTGAGACAGCAGTTGCCTGA<br>GAAGTATAAGGAGATTTTTTTGATCAGAGTAAGAATGGATATGCTGGATATATTGATG-<br>GAGGAGCTAGTCAGGAGGAGTTTTATAAGTTTATT | 110 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| codons | AAGCCTATTTTGGAGAAGATGGATGGAACAGAGGAGTTGTTGGTGAAGTTGAATAGAGAG-<br>GATTTGTTGAGAAAGCAGAGAACATTTGATAATG<br>GAAGTATTCCTCATCAGATTCATTTGGGAGAGTTGCATGCTATTTTGAGAAGACAGGAG-<br>GATTTTTATCCTTTTTTGAAGGATAATAGAGAGAA<br>GATTGAGAAGATTTTGACATTTAGAATTCCTTATTATGTGGGACCTTTGGCTAGAG-<br>GAAATAGTAGATTTGCTTGGATGACAAGAAAGAGTGAG<br>GAGACAATTACACCTTGGAATTTTGAGGAGGTGGTGGATAAGG-<br>GAGCTAGTGCTCAGAGTTTTATTGAGAGAATGACAAATTTTGATAAGAATT<br>TGCCTAATGAGAAGGTGTTGCCTAAGCATAGTTTGTTGTATGAGTATTTTA-<br>CAGTGTATAATGAGTTGACAAAGGTGAAGTATGTGACAGAGGG<br>AATGAGAAAGCCTGCTTTTTTGAGTGGGAGAGCAGAAGAAGGCTATTGTGGATTTGTTGTT-<br>TAAGACAAATAGAAAGGTGACAGTGAAGCAGTTG<br>AAGGAGGATTATTTTAAGAAGATTGAGTGTTTTGATAGTGTGGAGATTAGTGGAGTGGAG-<br>GATAGATTTAATGCTAGTTTGGGAACATATCATG<br>ATTTGTTGAAGATTATTAAGGATAAGGATTTTTTGGATAATGAGGAGAATGAGGATAT-<br>TTTGGAGGATATTGTGTTGACATTGACATTGTTTGA<br>GGATAGAGAGATGATTGAGGAGAGATTGAAGACATATGCTCATTTGTTTGATGATAAGGT-<br>GATGAAGCAGTTGAAGAGAAGAAGATATACAGGA<br>TGGGGAAGATTGAGTAGAAAGTTGATTAATGGAATTAGAGATAAGCAGAGTGGAAA-<br>GACAATTTTGGATTTTTTGAAGAGTGATGGATTTGCTA<br>ATAGAAATTTTATGCAGTTGATTCATGATGATAGTTTGACATTTAAGGAGGATAT-<br>TCAGAAGGCTCAGGTGAGTGGACAGGGAGATAGTTTGCA<br>TGAGCATATTGCTAATTTGGCTGGAAGTCCTGCTATTAAGAAGGGAATTTTGCAGACAGT-<br>GAAGGTGGTGGATGAGTTGGTGAAGGTGATGGGA<br>AGACATAAGCCTGAGAATATTGTGATTGAGATGGCTAGAGAGAATCA-<br>GACAACACAGAAGGGACAGAAGAATAGTAGAGAGAGAATGAAGAGAA<br>TTGAGGAGGGAATTAAGGAGTTGGGAAGTCAGATTTTGAAGGAGCATCCTGTGGAGAATA-<br>CACAGTTGCAGAATGAGAAGTTGTATTTGTATTA<br>TTTGCAGAATGGAAGAGATATGTATGTGGATCAGGAGTTGGATATTAATAGATTGAGT-<br>GATTATGATGTGGATCATATTGTGCCTCAGAGTTTT<br>TTGAAGGATGATAGTATTGATAATAAGGTGTTGACAAGAAGTGATAAGAATAGAG-<br>GAAAGAGTGATAATGTGCCTAGTGAGGAGGTGGTGAAGA<br>AGATGAAGAATTATTGGAGACAGTTGTTGAATGCTAAGTTGATTACACAGAGAAAGTTT-<br>GATAATTTGACAAAGGCTGAGAGAGGAGGATTGAG<br>TGAGTTGGATAAGGCTGGATTTATTAAGAGACAGTTGGTGGAGACAAGACAGATTA-<br>CAAAGCATGTGGCTCAGATTTTGGATAGTAGAATGAAT<br>ACAAAGTATGATGAGAATGATAAGTTGATTAGAGAGGTGAAGGTGATTACATT-<br>GAAGAGTAAGTTGGTGAGTGATTTTAGAAAGGATTTTCAGT<br>TTTATAAGGTGAGAGAGATTAATAATTATCATCATGCTCATGATGCTTATTT-<br>GAATGCTGTGGTGGGAACAGCTTTGATTAAGAAGTATCCTAA<br>GTTGGAGAGTGAGTTTGTGTATGGAGATTATAAGGTGTATGATGTGAGAAAGATGAT-<br>TGCTAAGAGTGAGCAGGAGATTGGAAAGGCTACAGCT<br>AAGTATTTTTTTATAGTAATATTATGAATTTTTTTAAGACAGAGATTACAT-<br>TGGCTAATGAGAGATTAGAAAGAGACCTTTGATTGAGACAA<br>ATGGAGAGACAGGAGAGATTGTGTGGGATAAGGGAAGAGATTTTGCTACAGT-<br>GAGAAAGGTGTTGAGTATGCCTCAGGTGAATATTGTGAAGAA<br>GACAGAGGTGCAGACAGGAGGATTTAGTAAGGAGAGTATTTTGCCTAAGAGAAATAGTGA-<br>TAAGTTGATTGCTAGAAAGAAGGATTGGGATCCT<br>AAGAAGTATGGAGGATTTGATAGTCCTACAGTGGCT-<br>TATAGTGTGTTGGTGGTGGCTAAGGTGGAGAAGGGAAAGAGTAAGAAGTTGAAGAGTG<br>TGAAGGAGTTGTTGGGAATTACAATTATGGAGAGAAGTAGTTTTGAAGAAGAATCCTATT-<br>GATTTTTTGGAGGCTAAGGGATATAAGGAGGTGAA<br>GAAGGATTTGATTATTAAGTTGCCTAAGTATAGTTTGTTTGAGTTGGAGAATG-<br>GAAGAAAGAGAATGTTGGCTAGTGCTGGAGAGTTGCAGAAG<br>GGAAATGAGTTGGCTTTGCCTAGTAAGTATGTGAATTTTTTTGTATTTGGCTAGTCATTAT-<br>GAGAAGTTGAAGGGAAGTCCTGAGGATAATGAGC<br>AGAAGCAGTTGTTTGTGGAGCAGCATAAGCATTATTTGGATGAGATTATTGAGCAGATT-<br>AGTGAGTTTAGTAAGAGAGTGATTTTGGCTGATGC<br>TAATTTGGATAAGGTGTTGAGTGCTTATAATAAGCATAGAGATAAGCCTATT-<br>AGAGAGCAGGCTGAGAATATTATTCATTTGTTTACATTGACA<br>AATTTGGGAGCTCCTGCTGCTTTTAAGTATTTTGATACAACAATTGATAGAAAGAGA-<br>TATACAAGTACAAAGGAGGTGTTGGATGCTACATTGA<br>TTCATCAGAGTATTACAGGATTGTATGAGACAAGAATTGATTTGAGTCAGTTGGGAG-<br>GAGATGGAGGAGGAAGTCCTAAGAAGAAGAGAAAGGT<br>GTGA | |
| Cas9 ORF using low A codons | ATGGACAAGAAGTACTCCATCGGCCTGGACATCGGCACCAACTCCGTGGGCTGGGCCGT-<br>GATCACCGACGAGTACAAGGTGCCCTCCAAGAAGT<br>TCAAGGTGCTGGGCAACACCGACCGGCACTCCATCAAGAAGAACCT-<br>GATCGGCGCCCTGCTGTTCGACTCCGGCGAGACCGCCGAGGCCACCCG<br>GCTGAAGCGGACCGCCCGGCGGCGGTACACCCGGCGGAAGAACCGGATCTGC-<br>TACCTGCAGGAGATCTTCTCCAACGAGATGGCCAAGGTGGAC<br>GACTCCTTCTTCCACCGGCTGGAGGAGTCCTTCCTGGTGGAG-<br>GAGGACAAGAAGCACGAGCGGCACCCCATCTTCGGCAACATCGTGGACGAGG<br>TGGCCTACCACGAGAAGTACCCCACCATCTACCACCTGCGGAAGAAGCTGGTGGACTC-<br>CACCGACAAGGCCGACCTGCGGCTGATCTACCTGGC | 111 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| of Table 4, with start and stop codons | CCTGGCCCACATGATCAAGTTCCGGGGCCACTTCCTGATCGAGGGCGACCTGAACCCCGACAACTCCGACGTGGACAAGCTGTTCATCCAGCTG GTGCAGACCTACAACCAGCTGTTCGAGGAGAACCCCATCAACGCCTCCGGCGTGGACGCCAAGGCCATCCTGTCCGCCCGGCTGTCCAAGTCCC GGCGGCTGGAGAACCTGATCGCCCAGCTGCCCGGCGAGAAGAAGAACGGCCTGTTCGGCAACCTGATCGCCCTGTCCCTGGGCCTGACCCCCAA CTTCAAGTCCAACTTCGACCTGGCCGAGGACGCCAAGCTGCAGCTGTCCAAGGACACCTACGACGACGACCTGGACAACCTGCTGGCCCAGATC GGCGACCAGTACGCCGACCTGTTCCTGGCCGCCAAGAACCTGTCCGACGCCATCCTGCTGTCCGACATCCTGCGGGTGAACACCGAGATCACCA AGGCCCCCCTGTCCGCCTCCATGATCAAGCGGTACGACGAGCACCACCAGGACCTGACCCTGCTGAAGGCCCTGGTGCGGCAGCAGCTGCCCGA GAAGTACAAGGAGATCTTCTTCGACCAGTCCAAGAACGGCTACGCCGGCTACATCGACGGCGGCGCCTCCCAGGAGGAGTTCTACAAGTTCATC AAGCCCATCCTGGAGAAGATGGACGGCACCGAGGAGCTGCTGGTGAAGCTGAACCGGGAGGACCTGCTGCGGAAGCAGCGGACCTTCGACAACG GCTCCATCCCCCACCAGATCCACCTGGGCGAGCTGCACGCCATCCTGCGGCGGCAGGAGGACTTCTACCCCTTCCTGAAGGACAACCGGGAGAA GATCGAGAAGATCCTGACCTTCCGGATCCCCTACTACGTGGGCCCCCTGGCCCGGGGCAACTCCCGGTTCGCCTGGATGACCCGGAAGTCCGAG GAGACCATCACCCCCTGGAACTTCGAGGAGGTGGTGGACAAGGGCGCCTCCGCCCAGTCCTTCATCGAGCGGATGACCAACTTCGACAAGAACC TGCCCAACGAGAAGGTGCTGCCCAAGCACTCCCTGCTGTACGAGTACTTCACCGTGTACAACGAGCTGACCAAGGTGAAGTACGTGACCGAGGG CATGCGGAAGCCCGCCTTCCTGTCCGGCGAGCAGAAGAAGGCCATCGTGGACCTGCTGTTCAAGACCAACCGGAAGGTGACCGTGAAGCAGCTG AAGGAGGACTACTTCAAGAAGATCGAGTGCTTCGACTCCGTGGAGATCTCCGGCGTGGAGGACCGGTTCAACGCCTCCCTGGGCACCTACCACG ACCTGCTGAAGATCATCAAGGACAAGGACTTCCTGGACAACGAGGAGAACGAGGACATCCTGGAGGACATCGTGCTGACCCTGACCCTGTTCGA GGACCGGGAGATGATCGAGGAGCGGCTGAAGACCTACGCCCACCTGTTCGACGACAAGGTGATGAAGCAGCTGAAGCGGCGGCGGTACACCGGC TGGGGCCGGCTGTCCCGGAAGCTGATCAACGGCATCCGGGACAAGCAGTCCGGCAAGACCATCCTGGACTTCCTGAAGTCCGACGGCTTCGCCA ACCGGAACTTCATGCAGCTGATCCACGACGACTCCCTGACCTTCAAGGAGGACATCCAGAAGGCCCAGGTGTCCGGCCAGGGCGACTCCCTGCA CGAGCACATCGCCAACCTGGCCGGCTCCCCCGCCATCAAGAAGGGCATCCTGCAGACCGTGAAGGTGGTGGACGAGCTGGTGAAGGTGATGGGC CGGCACAAGCCCGAGAACATCGTGATCGAGATGGCCCGGGAGAACCAGACCACCCAGAAGGGCCAGAAGAACTCCCGGGAGCGGATGAAGCGGA TCGAGGAGGGCATCAAGGAGCTGGGCTCCCAGATCCTGAAGGAGCACCCCGTGGAGAACACCCAGCTGCAGAACGAGAAGCTGTACCTGTACTA CCTGCAGAACGGCCGGGACATGTACGTGGACCAGGAGCTGGACATCAACCGGCTGTCCGACTACGACGTGGACCACATCGTGCCCCAGTCCTTC CTGAAGGACGACTCCATCGACAACAAGGTGCTGACCCGGTCCGACAAGAACCGGGGCAAGTCCGACAACGTGCCCTCCGAGGAGGTGGTGAAGA AGATGAAGAACTACTGGCGGCAGCTGCTGAACGCCAAGCTGATCACCCAGCGGAAGTTCGACAACCTGACCAAGGCCGAGCGGGGCGGCCTGTC CGAGCTGGACAAGGCCGGCTTCATCAAGCGGCAGCTGGTGGAGACCCGGCAGATCACCAAGCACGTGGCCCAGATCCTGGACTCCCGGATGAAC ACCAAGTACGACGAGAACGACAAGCTGATCCGGGAGGTGAAGGTGATCACCCTGAAGTCCAAGCTGGTGTCCGACTTCCGGAAGGACTTCCAGT TCTACAAGGTGCGGGAGATCAACAACTACCACCACGCCCACGACGCCTACCTGAACGCCGTGGTGGGCACCGCCCTGATCAAGAAGTACCCCAA GCTGGAGTCCGAGTTCGTGTACGGCGACTACAAGGTGTACGACGTGCGGAAGATGATCGCCAAGTCCGAGCAGGAGATCGGCAAGGCCACCGCC AAGTACTTCTTCTACTCCAACATCATGAACTTCTTCAAGACCGAGATCACCCTGGCCAACGGCGAGATCCGGAAGCGGCCCCTGATCGAGACCA ACGGCGAGACCGGCGAGATCGTGTGGGACAAGGGCCGGGACTTCGCCACCGTGCGGAAGGTGCTGTCCATGCCCCAGGTGAACATCGTGAAGAA GACCGAGGTGCAGACCGGCGGCTTCTCCAAGGAGTCCATCCTGCCCAAGCGGAACTCCGACAAGCTGATCGCCCGGAAGAAGGACTGGGACCCC AAGAAGTACGGCGGCTTCGACTCCCCCACCGTGGCCTACTCCGTGCTGGTGGTGGCCAAGGTGGAGAAGGGCAAGTCCAAGAAGCTGAAGTCCG TGAAGGAGCTGCTGGGCATCACCATCATGGAGCGGTCCTCCTTCGAGAAGAACCCCATCGACTTCCTGGAGGCCAAGGGCTACAAGGAGGTGAA GAAGGACCTGATCATCAAGCTGCCCAAGTACTCCCTGTTCGAGCTGGAGAACGGCCGGAAGCGGATGCTGGCCTCCGCCGGCGAGCTGCAGAAG GGCAACGAGCTGGCCCTGCCCTCCAAGTACGTGAACTTCCTGTACCTGGCCTCCCACTACGAGAAGCTGAAGGGCTCCCCCGAGGACAACGAGC AGAAGCAGCTGTTCGTGGAGCAGCACAAGCACTACCTGGACGAGATCATCGAGCAGATCTCCGAGTTCTCCAAGCGGGTGATCCTGGCCGACGC CAACCTGGACAAGGTGCTGTCCGCCTACAACAAGCACCGGGACAAGCCCATCCGGGAGCAGGCCGAGAACATCATCCACCTGTTCACCCTGACC AACCTGGGCGCCCCCGCCGCCTTCAAGTACTTCGACACCACCATCGACCGGAAGCGGTACACCTCCACCAAGGAGGTGCTGGACGCCACCCCTGA | |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | TCCACCAGTCCATCACCGGCCTGTACGAGACCCG-GATCGACCTGTCCCAGCTGGGCGGCGACGGCGGCGGCTCCCCCAAGAAGAAGCGGAAGGTGTGA | |
| Cas9 ORF using low A/U codons of Table 4, with start and stop codons | ATGGACAAGAAGTACAGCATCGGCCTGGACATCGGCACCAACAGCGTGGGCTGGGCCGT-GATCACCGACGAGTACAAGGTGCCCAGCAAGAAGT<br>TCAAGGTGCTGGGCAACACCGACCGGCACAGCATCAAGAAGAACCT-GATCGGCGCCCTGCTGTTCGACAGCGGCGAGACCGCCGAGGCCACCCG<br>GCTGAAGCGGACCGCCCGGCGGCGGTACACCCGGCGGAAGAACCGGATCTGC-TACCTGCAGGAGATCTTCAGCAACGAGATGGCCAAGGTGGAC<br>GACAGCTTCTTCCACCGGCTGGAGGAGAGCTTCCTGGTGGAG-GAGGACAAGAAGCACGAGCGGCACCCCATCTTCGGCAACATCGTGGACGAGG<br>TGGCCTACCACGAGAAGTACCCCACCATCTACCACCTGCG-GAAGAAGCTGGTGGACAGCACCGACAAGGCCGACCTGCGGCTGATCTACCTGGC<br>CCTGGCCCACATGATCAAGTTCCGGGGCCACTTCCTGATCGAGGGCGACCT-GAACCCCGACAACAGCGACGTGGACAAGCTGTTCATCCAGCTG<br>GTGCAGACCTACAACCAGCTGTTCGAGGAGAACCCCATCAACGCCAGCGGCGTGGACGC-CAAGGCCATCCTGAGCGCCCGGCTGAGCAAGAGCC<br>GGCGGCTGGAGAACCT-GATCGCCCAGCTGCCCGGCGAGAAGAAGAACGGCCTGTTCGGCAACCTGATCGCCCTGAGCCTGGGCCTGACCCCCAA<br>CTTCAAGAGCAACTTCGACCTGGCCGAGGACGCCAAGCTGCAGCTGAGCAAGGACACC-TACGACGACGACCTGGACAACCTGCTGGCCCAGATC<br>GGCGACCAGTACGCCGACCTGTTCCTGGCCGCCAAGAACCTGAGCGACGCCATCCTGCT-GAGCGACATCCTGCGGGTGAACACCGAGATCACCA<br>AGGCCCCCCTGAGCGCCAGCATGATCAAGCGGTACGACGAGCAC-CACCAGGACCTGACCCTGCTGAAGGCCCTGGTGCGGCAGCAGCTGCCCGA<br>GAAGTACAAGGAGATCTTCTTCGACCAGAGCAAGAACGGCTACGCCGGCTA-CATCGACGGCGGCGCCAGCCAGGAGGAGTTCTACAAGTTCATC<br>AAGCCCATCCTGGAGAAGATGGACGGCACCGAGGAGCTGCTGGTGAAGCTGAACCGG-GAGGACCTGCTGCGGAAGCAGCGGACCTTCGACAACG<br>GCAGCATCCCCCACCAGATCCACCTGGGCGAGCTGCACGCCATCCTGCGGCGGCAG-GAGGACTTCTACCCCTTCCTGAAGGACAACCGGGAGAA<br>GATCGAGAAGATCCTGACCTTCCGGATCCCCTAC-TACGTGGGCCCCCTGGCCCGGGGCAACAGCCGGTTCGCCTGGATGACCCGGAAGAGCGAG<br>GAGACCATCACCCCCTGGAACTTCGAG-GAGGTGGTGGACAAGGGCGCCAGCGCCCAGAGCTTCATCGAGCGGATGACCAACTTCGACAAGAACC<br>TGCCCAACGAGAAGGTGCTGCCCAAGCACAGCCTGCTGTACGAGTACTTCACCGTGTA-CAACGAGCTGACCAAGGTGAAGTACGTGACCGAGGG<br>CATGCGGAAGCCCGCCTTCCTGAGCGGCGAGCAGAAGAAGGCCATCGTGGACCTGCTGTT-CAAGACCAACCGGAAGGTGACCGTGAAGCAGCTG<br>AAGGAGGACTACTTCAAGAAGATCGAGTGCTTCGACAGCGTGGAGATCAGCGGCGTG-GAGGACCGGTTCAACGCCAGCCTGGGCACCTACCACG<br>ACCTGCTGAAGATCATCAAGGACAAGGACTTCCTGGACAACGAGGAGAACGAGGA-CATCCTGGAGGACATCGTGCTGACCCTGACCCTGTTCGA<br>GGACCGGGAGATGATCGAGGAGCGGCTGAAGACCTACGCCCACCTGTTCGACGACAAGGT-GATGAAGCAGCTGAAGCGGCGCGGTACACCGGC<br>TGGGGCCGGCTGAGCCGGAAGCTGATCAACGGCATCCGGGACAAGCAGAGCGGCAAGAC-CATCCTGGACTTCCTGAAGAGCGACGGCTTCGCCA<br>ACCGGAACTTCATGCAGCTGATCCACGACGACAGCCTGACCTTCAAGGAGGA-CATCCAGAAGGCCCAGGTGAGCGGCCAGGGCGACAGCCTGCA<br>CGAGCACATCGCCAACCTGGCCGGCAGCCCCGCCATCAAGAAGGGCATCCTGCAGACCGT-GAAGGTGGTGGACGAGCTGGTGAAGGTGATGGGC<br>CGGCACAAGCCCGAGAACATCGTGATCGAGATGGCCCGGGAGAACCAGAC-CACCCAGAAGGGCCAGAAGAACAGCCGGGAGCGGATGAAGCGGA<br>TCGAGGAGGGCATCAAGGAGCTGGGCAGCCAGATCCTGAAGGAGCACCCCGTG-GAGAACACCCAGCTGCAGAACGAGAAGCTGTACCTGTACTA<br>CCTGCAGAACGGCCGGGACATGTACGTGGACCAGGAGCTGGACATCAACCGGCT-GAGCGACTACGACGTGGACCACATCGTGCCCCAGAGCTTC<br>CTGAAGGACGACAGCATCGACAACAAGGTGCTGACCCG-GAGCGACAAGAACCGGGGCAAGAGCGACAACGTGCCCAGCGAGGAGGTGGTGAAGA<br>AGATGAAGAACTACTGGCGGCAGCTGCTGAACGCCAAGCTGATCACCCAGCG-GAAGTTCGACAACCTGACCAAGGCCGAGCGGGGCGGCCTGAG<br>CGAGCTGGACAAGGCCGGCTTCATCAAGCGGCAGCTGGTGGAGACCCGGCAGATCAC-CAAGCACGTGGCCCAGATCCTGGACAGCCGGATGAAC<br>ACCAAGTACGACGAGAACGACAAGCTGATCCGGGAGGTGAAGGTGATCACCCT-GAAGAGCAAGCTGGTGAGCGACTTCCGGAAGGACTTCCAGT<br>TCTACAAGGTGCGGGAGATCAACAACTACCACCACGCCCACGACGCCTACCT-GAACGCCGTGGTGGGCACCGCCCTGATCAAGAAGTACCCCAA<br>GCTGGAGAGCGAGTTCGTGTACGGCGACTACAAGGTGTACGACGTGCGGAAGATGATCGC-CAAGAGCGAGCAGGAGATCGGCAAGGCCACCGCC<br>AAGTACTTCTTCTACAGCAACATCATGAACTTCTTCAAGACCGAGATCACCCTGGC-CAACGGCGAGATCCGGAAGCGGCCCCTGATCGAGACCA<br>ACGGCGAGACCGGCGAGATCGTGTGGGACAAGGGCCGGGACTTCGCCACCGTGCG-GAAGGTGCTGAGCATGCCCCAGGTGAACATCGTGAAGAA<br>GACCGAGGTGCAGACCGGCGGCTTCAGCAAGGAGAGCATCCTGCCCAAGCG-GAACAGCGACAAGCTGATCGCCCGGAAGAAGGACTGGGACCCC | 112 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | AAGAAGTACGGCGGCTTCGACAGCCCCACCGTGGCCTACAGCGTGCTGGTGGTGGC-CAAGGTGGAGAAGGGCAAGAGCAAGAAGCTGAAGAGCGTGAAGGAGCTGCTGGGCATCACCATCATGGAGCGGAGCAGCTTCGAGAAGAACCC-CATCGACTTCCTGGAGGCCAAGGGCTACAAGGAGGTGAAGAAGGACCTGATCATCAAGCTGCCCAAGTACAGCCTGTTCGAGCTGGAGAACGGCCG-GAAGCGGATGCTGGCCAGCGCCGGCGAGCTGCAGAAGGGCAACGAGCTGGCCCTGCCCAGCAAGTACGTGAACTTCCTGTACCTGGCCAGCCAC-TACGAGAAGCTGAAGGGCAGCCCCGAGGACAACGAGCAGAAGCAGCTGTTCGTGGAGCAGCACAAGCACTACCTGGACGAGATCATCGAGCA-GATCAGCGAGTTCAGCAAGCGGGTGATCCTGGCCGACGCCAACCTGGACAAGGTGCTGAGCGCCTACAACAAGCACCGGGACAAGCCCATCCGG-GAGCAGGCCGAGAACATCATCCACCTGTTCACCCTGACCAACCTGGGCGCCCCCGCCGCCTTCAAGTACTTCGACACCACCATCGACCGGAAGCGGTA-CACCAGCACCAAGGAGGTGCTGGACGCCACCCTGATCCACCAGAGCATCACCGGCCTGTACGAGACCCGGATCGACCT-GAGCCAGCTGGGCGGCGACGGCGGCGGCAGCCCCAAGAAGAAGCGGAAGGTGTGA | |
| Cas9 ORF using low A codons of Table 4, with two C-terminal NLS sequences and start and stop codons | ATGGACAAGAAGTACTCCATCGGCCTGGACATCGGCACCAACTCCGTGGGCTGGGCCGT-GATCACCGACGAGTACAAGGTGCCCTCCAAGAAGTTCAAGGTGCTGGGCAACACCGACCGGCACTCCATCAAGAAGAACCT-GATCGGCGCCCTGCTGTTCGACTCCGGCGAGACCGCCGAGGCCACCCGGCTGAAGCGGACCGCCCGGCGGCGGTACACCCGGCGGAAGAACCGGATCTGC-TACCTGCAGGAGATCTTCTCCAACGAGATGGCCAAGGTGGACGACTCCTTCTTCCACCGGCTGGAGGAGTCCTTCCTGGTGGAG-GAGGACAAGAAGCACGAGCGGCACCCCATCTTCGGCAACATCGTGGACGAGGTGGCCTACCACGAGAAGTACCCCACCATCTACCACCTGCGGAAGAAGCTGGTGGACTC-CACCGACAAGGCCGACCTGCGGCTGATCTACCTGGCCCTGGCCCACATGATCAAGTTCCGGGGCCACTTCCTGATCGAGGGCGACCT-GAACCCCGACAACTCCGACGTGGACAAGCTGTTCATCCAGCTGGTGCAGACCTACAACCAGCTGTTCGAGGAGAACCCCATCAACGCCTCCGGCGTGGACGC-CAAGGCCATCCTGTCCGCCCGGCTGTCCAAGTCCCGGCGGCTGGAGAACCT-GATCGCCCAGCTGCCCGGCGAGAAGAAGAACGGCCTGTTCGGCAACCTGATCGCCCTGTCCCTGGGCCTGACCCCCAACTTCAAGTCCAACTTCGACCTGGCCGAGGACGCCAAGCTGCAGCTGTCCAAGGACACC-TACGACGACGACCTGGACAACCTGCTGGCCCAGATCGGCGACCAGTACGCCGACCTGTTCCTGGCCGCCAAGAACCTGTCCGACGC-CATCCTGCTGTCCGACATCCTGCGGGTGAACACCGAGATCACCAAGGCCCCCCTGTCCGCCTCCATGATCAAGCGGTACGACGAGCAC-CACCAGGACCTGACCCTGCTGAAGGCCCTGGTGCGGCAGCAGCTGCCCGAGAAGTACAAGGAGATCTTCTTCGACCAGTCCAAGAACGGCTACGCCGGCTA-CATCGACGGCGGCGCCTCCCAGGAGGAGTTCTACAAGTTCATCAAGCCCATCCTGGAGAAGATGGACGGCACCGAGGAGCTGCTGGTGAAGCTGAACCGG-GAGGACCTGCTGCGGAAGCAGCGGACCTTCGACAACGGCTCCATCCCCCACCAGATCCACCTGGGCGAGCTGCACGCCATCCTGCGGCGGCAG-GAGGACTTCTACCCCTTCCTGAAGGACAACCGGGAGAAGATCGAGAAGATCCTGACCTTCCGGATCCCCTAC-TACGTGGGCCCCCTGGCCCGGGGCAACTCCCGGTTCGCCTGGATGACCCGGAAGTCCGAGGAGACCATCACCCCCTGGAACTTCGAG-GAGGTGGTGGACAAGGGCGCCTCCGCCCAGTCCTTCATCGAGCGGATGACCAACTTCGACAAGAACCTGCCCAACGAGAAGGTGCTGCCCAAGCACTCCCTGCTGTACGAGTACTTCACCGTGTA-CAACGAGCTGACCAAGGTGAAGTACGTGACCGAGGGCATGCGGAAGCCCGCCTTCCTGTCCGGCGAGCAGAAGAAGGCCATCGTGGACCTGCTGTT-CAAGACCAACCGGAAGGTGACCGTGAAGCAGCTGAAGGAGGACTACTTCAAGAAGATCGAGTGCTTCGACTCCGTGGAGATCTCCGGCGTG-GAGGACCGGTTCAACGCCTCCCTGGGCACCTACCACGACCTGCTGAAGATCATCAAGGACAAGGACTTCCTGGACAACGAGGAGAACGAGGA-CATCCTGGAGGACATCGTGCTGACCCTGACCCTGTTCGAGGACCGGGAGATGATCGAGGAGCGGCTGAAGACCTACGCCCACCTGTTCGACGACAAGGT-GATGAAGCAGCTGAAGCGGCGGCGGTACACCGGCTGGGGCCGGCTGTCCCGGAAGCTGATCAACGGCATCCGGGACAAGCAGTCCGGCAAGAC-CATCCTGGACTTCCTGAAGTCCGACGGCTTCGCCAACCGGAACTTCATGCAGCTGATCCACGACGACTCCCTGACCTTCAAGGAGGA-CATCCAGAAGGCCCAGGTGTCCGGCCAGGGCGACTCCCTGCACGAGCACATCGCCAACCTGGCCGGCTCCCCCGCCATCAAGAAGGGCATCCTGCAGACCGT-GAAGGTGGTGGACGAGCTGGTGAAGGTGATGGGCCGGCACAAGCCCGAGAACATCGTGATCGAGATGGCCCGGGAGAACCAGAC-CACCCAGAAGGGCCAGAAGAACTCCCGGGAGCGGATGAAGCGGATCGAGGAGGGCATCAAGGAGCTGGGCTCCCAGATCCTGAAGGAGCACCCCGTG-GAGAACACCCAGCTGCAGAACGAGAAGCTGTACCTGTACTACCTGCAGAACGGCCGGGACATGTACGTGGACCAGGAGCTGGACAT-CAACCGGCTGTCCGACTACGACGTGGACCACATCGTGCCCCAGTCCTTCCTGAAGGACGACTC-CATCGACAACAAGGTGCTGACCCGGTCCGACAAGAACCGGGGCAAGTCCGACAACGTGCCCTCCGAGGAGGTGGTGAAGAAGATGAAGAACTACTGGCGGCAGCTGCTGAACGCCAAGCTGATCACCCAGCG-GAAGTTCGACAACCTGACCAAGGCCGAGCGGGGCGGCCTGTC | 113 |

-continued

Sequence Table
The following sequence table provides a listing of sequences disclosed herein. It is understood that if a DNA sequence (comprising Ts) is referenced with respect to an RNA, then Ts should be replaced with Us(which may be modified or unmodified depending on the context), and vice versa.

| Description | Sequence | SEQ ID No. |
|---|---|---|
| | CGAGCTGGACAAGGCCGGCTTCATCAAGCGGCAGCTGGTGGAGACCCGGCAGATCAC-CAAGCACGTGGCCCAGATCCTGGACTCCCGGATGAAC ACCAAGTACGACGAGAACGACAAGCTGATCCGGGAGGTGAAGGTGATCACCCTGAAGTC-CAAGCTGGTGTCCGACTTCCGGAAGGACTTCCAGT TCTACAAGGTGCGGGAGATCAACAACTACCACCACGCCCACGACGCCTACCT-GAACGCCGTGGTGGGCACCGCCCTGATCAAGAAGTACCCCAA GCTGGAGTCCGAGTTCGTGTACGGCGACTACAAGGTGTACGACGTGCGGAAGATGATCGC-CAAGTCCGAGCAGGAGATCGGCAAGGCCACCGCC AAGTACTTCTTCTACTCCAACATCATGAACTTCTTCAAGACCGAGATCACCCTGGC-CAACGGCGAGATCCGGAAGCGGCCCCTGATCGAGACCA ACGGCGAGACCGGCGAGATCGTGTGGGACAAGGGCCGGGACTTCGCCACCGTGCG-GAAGGTGCTGTCCATGCCCCAGGTGAACATCGTGAAGAA GACCGAGGTGCAGACCGGCGGCTTCTCCAAGGAGTCCATCCTGCCCAAGCG-GAACTCCGACAAGCTGATCGCCCGGAAGAAGGACTGGGACCCC AAGAAGTACGGCGGCTTCGACTCCCCCACCGTGGCCTACTCCGTGCTGGTGGTGGC-CAAGGTGGAGAAGGGCAAGTCCAAGAAGCTGAAGTCCG TGAAGGAGCTGCTGGGCATCACCATCATGGAGCGGTCCTCCTTCGAGAAGAACCC-CATCGACTTCCTGGAGGCCAAGGGCTACAAGGAGGTGAA GAAGGACCTGATCATCAAGCTGCCCAAGTACTCCCTGTTCGAGCTGGAGAACGGCCG-GAAGCGGATGCTGGCCTCCGCCGGCGAGCTGCAGAAG GGCAACGAGCTGGCCCTGCCCTCCAAGTACGTGAACTTCCTGTACCTGGCCTCCCAC-TACGAGAAGCTGAAGGGCTCCCCCGAGGACAACGAGC AGAAGCAGCTGTTCGTGGAGCAGCACAAGCACTACCTGGACGAGATCATCGAGCA-GATCTCCGAGTTCTCCAAGCGGGTGATCCTGGCCGACGC CAACCTGGACAAGGTGCTGTCCGCCTACAACAAGCACCGGGACAAGCCCATCCGG-GAGCAGGCCGAGAACATCATCCACCTGTTCACCCTGACC AACCTGGGCGCCCCCGCCGCCTTCAAGTACTTCGACACCACCATCGACCGGAAGCGGTA-CACCTCCACCAAGGAGGTGCTGGACGCCACCCTGA TCCACCAGTCCATCACCGGCCTGTACGAGACCCG-GATCGACCTGTCCCAGCTGGGCGGCGACGGCTCCGGCTCCCCCAAGAAGAAGCGGAAGGT GGACGGCTCCCCCAAGAAGAAGCGGAAGGTGGACTCCGGCTGA | |
| Cas9 nickase ORF using low A codons of Table 4, with start and stop codons | ATGGACAAGAAGTACTCCATCGGCCTGGCCATCGGCACCAACTCCGTGGGCTGGGCCGT-GATCACCGACGAGTACAAGGTGCCCTCCAAGAAGT TCAAGGTGCTGGGCAACACCGACCGGCACTCCATCAAGAAGAACCT-GATCGGCGCCCTGCTGTTCGACTCCGGCGAGACCGCCGAGGCCACCCG GCTGAAGCGGACCGCCCGGCGGCGGTACACCCGGCGGAAGAACCGGATCTGC-TACCTGCAGGAGATCTTCTCCAACGAGATGGCCAAGGTGGAC GACTCCTTCTTCCACCGGCTGGAGGAGTCCTTCCTGGTGGAG-GAGGACAAGAAGCACGAGCGGCACCCCATCTTCGGCAACATCGTGGACGAGG TGGCCTACCACGAGAAGTACCCCACCATCTACCACCTGCGGAAGAAGCTGGTGGACTC-CACCGACAAGGCCGACCTGCGGCTGATCTACCTGGC CCTGGCCCACATGATCAAGTTCCGGGGCCACTTCCTGATCGAGGGCGACCT-GAACCCCGACAACTCCGACGTGGACAAGCTGTTCATCCAGCTG GTGCAGACCTACAACCAGCTGTTCGAGGAGAACCCCATCAACGCCTCCGGCGTGGACGC-CAAGGCCATCCTGTCCGCCCGGCTGTCCAAGTCCC GGCGGCTGGAGAACCT-GATCGCCCAGCTGCCCGGCGAGAAGAAGAACGGCCTGTTCGGCAACCTGATCGCCCTGTCCCTGGGCCTGACCCCCAA CTTCAAGTCCAACTTCGACCTGGCCGAGGACGCCAAGCTGCAGCTGTCCAAGGACACC-TACGACGACGACCTGGACAACCTGCTGGCCCAGATC GGCGACCAGTACGCCGACCTGTTCCTGGCCGCCAAGAACCTGTCCGACGC-CATCCTGCTGTCCGACATCCTGCGGGTGAACACCGAGATCACCA AGGCCCCCCTGTCCGCCTCCATGATCAAGCGGTACGACGAGCAC-CACCAGGACCTGACCCTGCTGAAGGCCCTGGTGCGGCAGCAGCTGCCCGA GAAGTACAAGGAGATCTTCTTCGACCAGTCCAAGAACGGCTACGCCGGCTA-CATCGACGGCGGCGCCTCCCAGGAGGAGTTCTACAAGTTCATC AAGCCCATCCTGGAGAAGATGGACGGCACCGAGGAGCTGCTGGTGAAGCTGAACCGG-GAGGACCTGCTGCGGAAGCAGCGGACCTTCGACAACG GCTCCATCCCCCACCAGATCCACCTGGGCGAGCTGCACGCCATCCTGCGGCGGCAG-GAGGACTTCTACCCCTTCCTGAAGGACAACCGGGAGAA GATCGAGAAGATCCTGACCTTCCGGATCCCCTAC-TACGTGGGCCCCCTGGCCCGGGGCAACTCCCGGTTCGCCTGGATGACCCGGAAGTCCGAG GAGACCATCACCCCCTGGAACTTCGAG-GAGGTGGTGGACAAGGGCGCCTCCGCCCAGTCCTTCATCGAGCGGATGACCAACTTCGACAAGAACC TGCCCAACGAGAAGGTGCTGCCCAAGCACTCCCTGCTGTACGAGTACTTCACCGTGTA-CAACGAGCTGACCAAGGTGAAGTACGTGACCGAGGG CATGCGGAAGCCCGCCTTCCTGTCCGGCGAGCAGAAGAAGGCCATCGTGGACCTGCTGTT-CAAGACCAACCGGAAGGTGACCGTGAAGCAGCTG AAGGAGGACTACTTCAAGAAGATCGAGTGCTTCGACTCCGTGGAGATCTCCGGCGTG-GAGGACCGGTTCAACGCCTCCCTGGGCACCTACCACG ACCTGCTGAAGATCATCAAGGACAAGGACTTCCTGGACAACGAGGAGAACGAGGA-CATCCTGGAGGACATCGTGCTGACCCTGACCCTGTTCGA GGACCGGGAGATGATCGAGGAGCGGCTGAAGACCTACGCCCACCTGTTCGACGACAAGGT-GATGAAGCAGCTGAAGCGGCGGCGGTACACCGGC TGGGGCCGGCTGTCCCGGAAGCTGATCAACGGCATCCGGGACAAGCAGTCCGGCAAGAC-CATCCTGGACTTCCTGAAGTCCGACGGCTTCGCCA | 114 |

| Description | Sequence | SEQ ID No. |
|---|---|---|
| | ACCGGAACTTCATGCAGCTGATCCACGACGACTCCCTGACCTTCAAGGAGGA-CATCCAGAAGGCCCAGGTGTCCGGCCAGGGCGACTCCCTGCA CGAGCACATCGCCAACCTGGCCGGCTCCCCCGCCATCAAGAAGGGCATCCTGCAGACCGT-GAAGGTGGTGGACGAGCTGGTGAAGGTGATGGGC CGGCACAAGCCCGAGAACATCGTGATCGAGATGGCCCGGGAGAACCAGAC-CACCCAGAAGGGCCAGAAGAACTCCCGGGAGCGGATGAAGCGGA TCGAGGAGGGCATCAAGGAGCTGGGCTCCCAGATCCTGAAGGAGCACCCCGTG-GAGAACACCCAGCTGCAGAACGAGAAGCTGTACCTGTACTA CCTGCAGAACGGCCGGGACATGTACGTGGACCAGGAGCTGGACAT-CAACCGGCTGTCCGACTACGACGTGGACCACATCGTGCCCCAGTCCTTC CTGAAGGACGACTC-CATCGACAACAAGGTGCTGACCCGGTCCGACAAGAACCGGGGCAAGTCCGACAACGTGCCCTCCGAGGAGGTGGTGAAGA AGATGAAGAACTACTGGCGGCAGCTGCTGAACGCCAAGCTGATCACCCAGCG-GAAGTTCGACAACCTGACCAAGGCCGAGCGGGGCGGCCTGTC CGAGCTGGACAAGGCCGGCTTCATCAAGCGGCAGCTGGTGGAGACCCGGCAGATCAC-CAAGCACGTGGCCCAGATCCTGGACTCCCGGATGAAC ACCAAGTACGACGAGAACGACAAGCTGATCCGGGAGGTGAAGGTGATCACCCTGAAGTC-CAAGCTGGTGTCCGACTTCCGGAAGGACTTCCAGT TCTACAAGGTGCGGGAGATCAACAACTACCACCACGCCCACGACGCCTACCT-GAACGCCGTGGTGGGCACCGCCCTGATCAAGAAGTACCCCAA GCTGGAGTCCGAGTTCGTGTACGGCGACTACAAGGTGTACGACGTGCGGAAGATGATCGC-CAAGTCCGAGCAGGAGATCGGCAAGGCCACCGCC AAGTACTTCTTCTACTCCAACATCATGAACTTCTTCAAGACCGAGATCACCCTGGC-CAACGGCGAGATCCGGAAGCGGCCCCTGATCGAGACCA ACGGCGAGACCGGCGAGATCGTGTGGGACAAGGGCCGGGACTTCGCCACCGTGCG-GAAGGTGCTGTCCATGCCCCAGGTGAACATCGTGAAGAA GACCGAGGTGCAGACCGGCGGCTTCTCCAAGGAGTCCATCCTGCCCAAGCG-GAACTCCGACAAGCTGATCGCCCGGAAGAAGGACTGGGACCCC AAGAAGTACGGCGGCTTCGACTCCCCCACCGTGGCCTACTCCGTGCTGGTGGTGGC-CAAGGTGGAGAAGGGCAAGTCCAAGAAGCTGAAGTCCG TGAAGGAGCTGCTGGGCATCACCATCATGGAGCGGTCCTCCTTCGAGAAGAACCC-CATCGACTTCCTGGAGGCCAAGGGCTACAAGGAGGTGAA GAAGGACCTGATCATCAAGCTGCCCAAGTACTCCCTGTTCGAGCTGGAGAACGGCCG-GAAGCGGATGCTGGCCTCCGCGGCGAGCTGCAGAAG GGCAACGAGCTGGCCCTGCCCTCCAAGTACGTGAACTTCCTGTACCTGGCCTCCCAC-TACGAGAAGCTGAAGGGCTCCCCCGAGGACAACGAGC AGAAGCAGCTGTTCGTGGAGCAGCACAAGCACTACCTGGACGAGATCATCGAGCA-GATCTCCGAGTTCTCCAAGCGGGTGATCCTGGCCGACGC CAACCTGGACAAGGTGCTGTCCGCCTACAACAAGCACCGGGACAAGCCCATCCGG-GAGCAGGCCGAGAACATCATCCACCTGTTCACCCTGACC AACCTGGGCGCCCCCGCCGCCTTCAAGTACTTCGACACCACCATCGACCGGAAGCGGTA-CACCTCCACCAAGGAGGTGCTGGACGCCACCCTGA TCCACCAGTCCATCACCGGCCTGTACGAGACCCG-GATCGACCTGTCCCAGCTGGGCGGCGACGGCGGCGGCTCCCCCAAGAAGAAGCGGAAGGT GTGA | |
| Cas9 nick- ase ORF using low A codons of Table 4, with start and stop codons | ATGGACAAGAAGTACTCCATCGGCCTGGCCATCGGCACCAACTCCGTGGGCTGGGCCGT-GATCACCGACGAGTACAAGGTGCCCTCCAAGAAGT TCAAGGTGCTGGGCAACACCGACCGGCACTCCATCAAGAAGAACCT-GATCGGCGCCCTGCTGTTCGACTCCGGCGAGACCGCCGAGGCCACCCG GCTGAAGCGGACCGCCCGGCGGCGGTACACCCGGCGGAAGAACCGGATCTGC-TACCTGCAGGAGATCTTCTCCAACGAGATGGCCAAGGTGGAC GACTCCTTCTTCCACCGGCTGGAGGAGTCCTTCCTGGTGGAG-GAGGACAAGAAGCACGAGCGGCACCCCATCTTCGGCAACATCGTGGACGAGG TGGCCTACCACGAGAAGTACCCCACCATCTACCACCTGCGGAAGAAGCTGGTGGACTC-CACCGACAAGGCCGACCTGCGGCTGATCTACCTGGC CCTGGCCCACATGATCAAGTTCCGGGGCCACTTCCTGATCGAGGGCGACCT-GAACCCCGACAACTCCGACGTGGACAAGCTGTTCATCCAGCTG GTGCAGACCTACAACCAGCTGTTCGAGGAGAACCCCATCAACGCCTCCGGCGTGGACGC-CAAGGCCATCCTGTCCGCCCGGCTGTCCAAGTCCC GGCGGCTGGAGAACCT-GATCGCCCAGCTGCCCGGCGAGAAGAAGAACGGCCTGTTCGGCAACCTGATCGCCCTGTCCCTGGGCCTGACCCCCAA CTTCAAGTCCAACTTCGACCTGGCCGAGGACGCCAAGCTGCAGCTGTCCAAGGACACC-TACGACGACGACCTGGACAACCTGCTGGCCCAGATC GGCGACCAGTACGCCGACCTGTTCCTGGCCGCCAAGAACCTGTCCGACGC-CATCCTGCTGTCCGACATCCTGCGGGTGAACACCGAGATCACCA AGGCCCCCCTGTCCGCCTCCATGATCAAGCGGTACGACGAGCAC-CACCAGGACCTGACCCTGCTGAAGGCCCTGGTGCGGCAGCAGCTGCCCGA GAAGTACAAGGAGATCTTCTTCGACCAGTCCAAGAACGGCTACGCCGGCTA-CATCGACGGCGGCGCCTCCCAGGAGGAGTTCTACAAGTTCATC AAGCCCATCCTGGAGAAGATGGACGGCACCGAGGAGCTGCTGGTGAAGCTGAACCGG-GAGGACCTGCTGCGGAAGCAGCGGACCTTCGACAACG GCTCCATCCCCCACCAGATCCACCTGGGCGAGCTGCACGCCATCCTGCGGCGGCAG-GAGGACTTCTACCCCTTCCTGAAGGACAACCGGGAGAA GATCGAGAAGATCCTGACCTTCCGGATCCCCTAC-TACGTGGGCCCCCTGGCCCGGGGCAACTCCCGGTTCGCCTGGATGACCCGGAAGTCCGAG | 115 |

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| and no NLS | GAGACCATCACCCCTGGAACTTCGAG-GAGGTGGTGGACAAGGGCGCCTCCGCCCAGTCCTTCATCGAGCGGATGACCAACTTCGACAAGAACC TGCCCAACGAGAAGGTGCTGCCCAAGCACTCCCTGCTGTACGAGTACTTCACCGTGTA-CAACGAGCTGACCAAGGTGAAGTACGTGACCGAGGG CATGCGGAAGCCCGCCTTCCTGTCCGGCGAGCAGAAGAAGGCCATCGTGGACCTGCTGTT-CAAGACCAACCGGAAGGTGACCGTGAAGCAGCTG AAGGAGGACTACTTCAAGAAGATCGAGTGCTTCGACTCCGTGGAGATCTCCGGCGTG-GAGGACCGGTTCAACGCCTCCCTGGGCACCTACCACG ACCTGCTGAAGATCATCAAGGACAAGGACTTCCTGGACAACGAGGAGAACGAGGA-CATCCTGGAGGACATCGTGCTGACCCTGACCCTGTTCGA GGACCGGGAGATGATCGAGGAGCGGCTGAAGACCTACGCCCACCTGTTCGACGACAAGGT-GATGAAGCAGCTGAAGCGGCGGCGGTACACCGGC TGGGGCCGGCTGTCCCGGAAGCTGATCAACGGCATCCGGGACAAGCAGTCCGGCAAGAC-CATCCTGGACTTCCTGAAGTCCGACGGCTTCGCCA ACCGGAACTTCATGCAGCTGATCCACGACGACTCCCTGACCTTCAAGGAGGA-CATCCAGAAGGCCCAGGTGTCCGGCCAGGGCGACTCCCTGCA CGAGCACATCGCCAACCTGGCCGGCTCCCCCGCCATCAAGAAGGGCATCCTGCAGACCGT-GAAGGTGGTGGACGAGCTGGTGAAGGTGATGGGC CGGCACAAGCCCGAGAACATCGTGATCGAGATGGCCCGGGAGAACCAGAC-CACCCAGAAGGGCCAGAAGAACTCCCGGGAGCGGATGAAGCGGA TCGAGGAGGGCATCAAGGAGCTGGGCTCCCAGATCCTGAAGGAGCACCCCGTG-GAGAACACCCAGCTGCAGAACGAGAAGCTGTACCTGTACTA CCTGCAGAACGGCCGGGACATGTACGTGGACCAGGAGCTGGACAT-CAACCGGCTGTCCGACTACGACGTGGACCACATCGTGCCCCAGTCCTTC CTGAAGGACGACTC-CATCGACAACAAGGTGCTGACCCGGTCCGACAAGAACCGGGGCAAGTCCGACAACGTGCCCTCCGAGGAGGTGGTGAAGA AGATGAAGAACTACTGGCGGCAGCTGCTGAACGCCAAGCTGATCACCCAGCG-GAAGTTCGACAACCTGACCAAGGCCGAGCGGGGCGGCCTGTC CGAGCTGGACAAGGCCGGCTTCATCAAGCGGCAGCTGGTGGAGACCCGGCAGATCAC-CAAGCACGTGGCCCAGATCCTGGACTCCCGGATGAAC ACCAAGTACGACGAGAACGACAAGCTGATCCGGGAGGTGAAGGTGATCACCCTGAAGTC-CAAGCTGGTGTCCGACTTCCGGAAGGACTTCCAGT TCTACAAGGTGCGGGAGATCAACAACTACCACCACGCCCACGACGCCTACCT-GAACGCCGTGGTGGGCACCGCCCTGATCAAGAAGTACCCCAA GCTGGAGTCCGAGTTCGTGTACGGCGACTACAAGGTGTACGACGTGCGGAAGATGATCGC-CAAGTCCGAGCAGGAGATCGGCAAGGCCACCGCC AAGTACTTCTTCTACTCCAACATCATGAACTTCTTCAAGACCGAGATCACCCTGGC-CAACGGCGAGATCCGGAAGCGGCCCCTGATCGAGACCA ACGGCGAGACCGGCGAGATCGTGTGGGACAAGGGCCGGGACTTCGCCACCGTGCG-GAAGGTGCTGTCCATGCCCCAGGTGAACATCGTGAAGAA GACCGAGGTGCAGACCGGCGGCTTCTCCAAGGAGTCCATCCTGCCCAAGCG-GAACTCCGACAAGCTGATCGCCCGGAAGAAGGACTGGGACCCC AAGAAGTACGGCGGCTTCGACTCCCCCACCGTGGCCTACTCCGTGCTGGTGGTGGC-CAAGGTGGAGAAGGGCAAGTCCAAGAAGCTGAAGTCCG TGAAGGAGCTGCTGGGCATCACCATCATGGAGCGGTCCTCCTTCGAGAAGAACCC-CATCGACTTCCTGGAGGCCAAGGGCTACAAGGAGGTGAA GAAGGACCTGATCATCAAGCTGCCCAAGTACTCCCTGTTCGAGCTGGAGAACGGCCG-GAAGCGGATGCTGGCCTCCGCCGGCGAGCTGCAGAAG GGCAACGAGCTGGCCCTGCCCTCCAAGTACGTGAACTTCCTGTACCTGGCCTCCCAC-TACGAGAAGCTGAAGGGCTCCCCCGAGGACAACGAGC AGAAGCAGCTGTTCGTGGAGCAGCACAAGCACTACCTGGACGAGATCATCGAGCA-GATCTCCGAGTTCTCCAAGCGGGTGATCCTGGCCGACGC CAACCTGGACAAGGTGCTGTCCGCCTACAACAAGCACCGGGACAAGCCCATCCGG-GAGCAGGCCGAGAACATCATCCACCTGTTCACCCTGACC AACCTGGGCGCCCCCGCCGCCTTCAAGTACTTCGACACCACCATCGACCGGAAGCGGTA-CACCTCCACCAAGGAGGTGCTGGACGCCACCCTGA TCCACCAGTCCATCACCGGCCTGTACGAGACCCGGATCGACCTGTCCCAGCTGGGCGGCGACTGA | |
| Cas9 nickase ORF using low A codons of Table | ATGGACAAGAAGTACTCCATCGGCCTGGCCATCGGCACCAACTCCGTGGGCTGGGCCGT-GATCACCGACGAGTACAAGGTGCCCTCCAAGAAGT TCAAGGTGCTGGGCAACACCGACCGGCACTCCATCAAGAAGAACCT-GATCGGCGCCCTGCTGTTCGACTCCGGCGAGACCGCCGAGGCCACCCG GCTGAAGCGGACCGCCCGGCGGCGGTACACCCGGCGGAAGAACCGGATCTGC-TACCTGCAGGAGATCTTCTCCAACGAGATGGCCAAGGTGGAC GACTCCTTCTTCCACCGGCTGGAGGAGTCCTTCCTGGTGGAG-GAGGACAAGAAGCACGAGCGGCACCCCATCTTCGGCAACATCGTGGACGAGG TGGCCTACCACGAGAAGTACCCCACCATCTACCACCTGCGGAAGAAGCTGGTGGACTC-CACCGACAAGGCCGACCTGCGGCTGATCTACCTGGC CCTGGCCCACATGATCAAGTTCCGGGGCCACTTCCTGATCGAGGGCGACCT-GAACCCCGACAACTCCGACGTGGACAAGCTGTTCATCCAGCTG GTGCAGACCTACAACCAGCTGTTCGAGGAGAACCCCATCAACGCCTCCGGCGTGGACGC-CAAGGCCATCCTGTCCGCCCGGCTGTCCAAGTCCC GGCGGCTGGAGAACCT-GATCGCCCAGCTGCCCGGCGAGAAGAAGAACGGCCTGTTCGGCAACCTGATCGCCCTGTCCCTGGGCCTGACCCCCAA CTTCAAGTCCAACTTCGACCTGGCCGAGGACGCCAAGCTGCAGCTGTCCAAGGACACC-TACGACGACGACCTGGACAACCTGCTGGCCCAGATC | 116 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| 4, with two C-terminal NLS sequences and start and stop codons | GGCGACCAGTACGCCGACCTGTTCCTGGCCGCCAAGAACCTGTCCGACGC-CATCCTGCTGTCCGACATCCTGCGGGTGAACACCGAGATCACCA AGGCCCCCCTGTCCGCCTCCATGATCAAGCGGTACGACGAGCAC-CACCAGGACCTGACCCTGCTGAAGGCCCTGGTGCGGCAGCAGCTGCCCGA GAAGTACAAGGAGATCTTCTTCGACCAGTCCAAGAACGGCTACGCCGGCTA-CATCGACGGCGGCGCCTCCCAGGAGGAGTTCTACAAGTTCATC AAGCCCATCCTGGAGAAGATGGACGGCACCGAGGAGCTGCTGGTGAAGCTGAACCGG-GAGGACCTGCTGCGGAAGCAGCGGACCTTCGACAACG GCTCCATCCCCCACCAGATCCACCTGGGCGAGCTGCACGCCATCCTGCGGCGGCAG-GAGGACTTCTACCCCTTCCTGAAGGACAACCGGGAGAA GATCGAGAAGATCCTGACCTTCCGGATCCCCTAC-TACGTGGGCCCCCTGGCCCGGGGCAACTCCCGGTTCGCCTGGATGACCCGGAAGTCCGAG GAGACCATCACCCCCTGGAACTTCGAG-GAGGTGGTGGACAAGGGCGCCTCCGCCCAGTCCTTCATCGAGCGGATGACCAACTTCGACAAGAACC TGCCCAACGAGAAGGTGCTGCCCAAGCACTCCCTGCTGTACGAGTACTTCACCGTGTA-CAACGAGCTGACCAAGGTGAAGTACGTGACCGAGGG CATGCGGAAGCCCGCCTTCCTGTCCGGCGAGCAGAAGAAGGCCATCGTGGACCTGCTGTT-CAAGACCAACCGGAAGGTGACCGTGAAGCAGCTG AAGGAGGACTACTTCAAGAAGATCGAGTGCTTCGACTCCGTGGAGATCTCCGGCGTG-GAGGACCGGTTCAACGCCTCCCTGGGCACCTACCACG ACCTGCTGAAGATCATCAAGGACAAGGACTTCCTGGACAACGAGGAGAACGAGGA-CATCCTGGAGGACATCGTGCTGACCCTGACCCTGTTCGA GGACCGGGAGATGATCGAGGAGCGGCTGAAGACCTACGCCCACCTGTTCGACGACAAGGT-GATGAAGCAGCTGAAGCGGCGGCGGTACACCGGC TGGGGCCGGCTGTCCCGGAAGCTGATCAACGGCATCCGGGACAAGCAGTCCGGCAAGAC-CATCCTGGACTTCCTGAAGTCCGACGGCTTCGCCA ACCGGAACTTCATGCAGCTGATCCACGACGACTCCCTGACCTTCAAGGAGGA-CATCCAGAAGGCCCAGGTGTCCGGCCAGGGCGACTCCCTGCA CGAGCACATCGCCAACCTGGCCGGCTCCCCCGCCATCAAGAAGGGCATCCTGCAGACCGT-GAAGGTGGTGGACGAGCTGGTGAAGGTGATGGGC CGGCACAAGCCCGAGAACATCGTGATCGAGATGGCCCGGGAGAACCAGAC-CACCCAGAAGGGCCAGAAGAACTCCCGGGAGCGGATGAAGCGGA TCGAGGAGGGCATCAAGGAGCTGGGCTCCCAGATCCTGAAGGAGCACCCCGTG-GAGAACACCCAGCTGCAGAACGAGAAGCTGTACCTGTACTA CCTGCAGAACGGCCGGGACATGTACGTGGACCAGGAGCTGGACAT-CAACCGGCTGTCCGACTACGACGTGGACCACATCGTGCCCCAGTCCTTC CTGAAGGACGACTC-CATCGACAACAAGGTGCTGACCCGGTCCGACAAGAACCGGGGCAAGTCCGACAACGTGCCCTCCGAGGAGGTGGTGAAGA AGATGAAGAACTACTGGCGGCAGCTGCTGAACGCCAAGCTGATCACCCAGCG-GAAGTTCGACAACCTGACCAAGGCCGAGCGGGGCGGCCTGTC CGAGCTGGACAAGGCCGGCTTCATCAAGCGGCAGCTGGTGGAGACCCGGCAGATCAC-CAAGCACGTGGCCCAGATCCTGGACTCCCGGATGAAC ACCAAGTACGACGAGAACGACAAGCTGATCCGGGAGGTGAAGGTGATCACCCTGAAGTC-CAAGCTGGTGTCCGACTTCCGGAAGGACTTCCAGT TCTACAAGGTGCGGGAGATCAACAACTACCACCACGCCCACGACGCCTACCT-GAACGCCGTGGTGGGCACCGCCCTGATCAAGAAGTACCCCAA GCTGGAGTCCGAGTTCGTGTACGGCGACTACAAGGTGTACGACGTGCGGAAGATGATCGC-CAAGTCCGAGCAGGAGATCGGCAAGGCCACCGCC AAGTACTTCTTCTACTCCAACATCATGAACTTCTTCAAGACCGAGATCACCCTGGC-CAACGGCGAGATCCGGAAGCGGCCCCTGATCGAGACCA ACGGCGAGACCGGCGAGATCGTGTGGGACAAGGGCCGGGACTTCGCCACCGTGCG-GAAGGTGCTGTCCATGCCCCAGGTGAACATCGTGAAGAA GACCGAGGTGCAGACCGGCGGCTTCTCCAAGGAGTCCATCCTGCCCAAGCG-GAACTCCGACAAGCTGATCGCCCGGAAGAAGGACTGGGACCCC AAGAAGTACGGCGGCTTCGACTCCCCCACCGTGGCCTACTCCGTGCTGGTGGTGGC-CAAGGTGGAGAAGGGCAAGTCCAAGAAGCTGAAGTCCG TGAAGGAGCTGCTGGGCATCACCATCATGGAGCGGTCCTCCTTCGAGAAGAACCC-CATCGACTTCCTGGAGGCCAAGGGCTACAAGGAGGTGAA GAAGGACCTGATCATCAAGCTGCCCAAGTACTCCCTGTTCGAGCTGGAGAACGGCCG-GAAGCGGATGCTGGCCTCCGCCGGCGAGCTGCAGAAG GGCAACGAGCTGGCCCTGCCCTCCAAGTACGTGAACTTCCTGTACCTGGCCTCCCAC-TACGAGAAGCTGAAGGGCTCCCCCGAGGACAACGAGC AGAAGCAGCTGTTCGTGGAGCAGCACAAGCACTACCTGGACGAGATCATCGAGCA-GATCTCCGAGTTCTCCAAGCGGGTGATCCTGGCCGACGC CAACCTGGACAAGGTGCTGTCCGCCTACAACAAGCACCGGGACAAGCCCATCCGG-GAGCAGGCCGAGAACATCATCCACCTGTTCACCCTGACC AACCTGGGCGCCCCCGCCGCCTTCAAGTACTTCGACACCACCATCGACCGGAAGCGGTA-CACCTCCACCAAGGAGGTGCTGGACGCCACCCTGA TCCACCAGTCCATCACCGGCCTGTACGAGACCCG-GATCGACCTGTCCCAGCTGGGCGGCGACGGCTCCGGCTCCCCCAAGAAGAAGCGGAAGGT GGACGGCTCCCCCAAGAAGAAGCGGAAGGTGGACTCCGGCTGA | |
| dCas9 ORF | ATGGACAAGAAGTACTCCATCGGCCTGGCCATCGGCACCAACTCCGTGGGCTGGGCCGT-GATCACCGACGAGTACAAGGTGCCCTCCAAGAAGT TCAAGGTGCTGGGCAACACCGACCGGCACTCCATCAAGAAGAACCT-GATCGGCGCCCTGCTGTTCGACTCCGGCGAGACCGCCGAGGCCACCCG | 117 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| using low A codons of Table 4, with start and stop codons | GCTGAAGCGGACCGCCCGGCGGCGGTACACCCGGCGGAAGAACCGGATCTGC-TACCTGCAGGAGATCTTCTCCAACGAGATGGCCAAGGTGGAC GACTCCTTCTTCCACCGGCTGGAGGAGTCCTTCCTGGTGGAG-GAGGACAAGAAGCACGAGCGGCACCCCATCTTCGGCAACATCGTGGACGAGG TGGCCTACCACGAGAAGTACCCCACCATCTACCACCTGCGGAAGAAGCTGGTGGACTC-CACCGACAAGGCCGACCTGCGGCTGATCTACCTGGC CCTGGCCCACATGATCAAGTTCCGGGGCCACTTCCTGATCGAGGGCGACCT-GAACCCCGACAACTCCGACGTGGACAAGCTGTTCATCCAGCTG GTGCAGACCTACAACCAGCTGTTCGAGGAGAACCCCATCAACGCCTCCGGCGTGGACGC-CAAGGCCATCCTGTCCGCCCGGCTGTCCAAGTCCC GGCGGCTGGAGAACCT-GATCGCCCAGCTGCCCGGCGAGAAGAAGAACGGCCTGTTCGGCAACCTGATCGCCCTGTCCCTGGGCCTGACCCCCAA CTTCAAGTCCAACTTCGACCTGGCCGAGGACGCCAAGCTGCAGCTGTCCAAGGACACC-TACGACGACGACCTGGACAACCTGCTGGCCCAGATC GGCGACCAGTACGCCGACCTGTTCCTGGCCGCCAAGAACCTGTCCGACGC-CATCCTGCTGTCCGACATCCTGCGGGTGAACACCGAGATCACCA AGGCCCCCTGTCCGCCTCCATGATCAAGCGGTACGACGAGCAC-CACCAGGACCTGACCCTGCTGAAGGCCCTGGTGCGGCAGCAGCTGCCCGA GAAGTACAAGGAGATCTTCTTCGACCAGTCCAAGAACGGCTACGCCGGCTA-CATCGACGGCGGCGCCTCCCAGGAGGAGTTCTACAAGTTCATC AAGCCCATCCTGGAGAAGATGGACGGCACCGAGGAGCTGCTGGTGAAGCTGAACCGG-GAGGACCTGCTGCGGAAGCAGCGGACCTTCGACAACG GCTCCATCCCCCACCAGATCCACCTGGGCGAGCTGCACGCCATCCTGCGGCGGCAG-GAGGACTTCTACCCCTTCCTGAAGGACAACGGGAGAA GATCGAGAAGATCCTGACCTTCCGGATCCCCTAC-TACGTGGGCCCCCTGGCCCGGGGCAACTCCCGGTTCGCCTGGATGACCCGGAAGTCCGAG GAGACCATCACCCCCTGGAACTTCGAG-GAGGTGGTGGACAAGGGCGCCTCCGCCCAGTCCTTCATCGAGCGGATGACCAACTTCGACAAGAACC TGCCCAACGAGAAGGTGCTGCCCAAGCACTCCCTGCTGTACGAGTACTTCACCGTGTA-CAACGAGCTGACCAAGGTGAAGTACGTGACCGAGGG CATGCGGAAGCCCGCCTTCCTGTCCGGCGAGCAGAAGAAGGCCATCGTGGACCTGCTGTT-CAAGACCAACCGGAAGGTGACCGTGAAGCAGCTG AAGGAGGACTACTTCAAGAAGATCGAGTGCTTCGACTCCGTGGAGATCTCCGGCGTG-GAGGACCGGTTCAACGCCTCCCTGGGCACCTACCACG ACCTGCTGAAGATCATCAAGGACAAGGACTTCCTGGACAACGAGGAGAACGAGGA-CATCCTGGAGGACATCGTGCTGACCCTGACCCTGTTCGA GGACCGGGAGATGATCGAGGAGCGGCTGAAGACCTACGCCCACCTGTTCGACGACAAGGT-GATGAAGCAGCTGAAGCGGCGGCGGTACACCGGC TGGGGCCGGCTGTCCCGGAAGCTGATCAACGGCATCCGGGACAAGCAGTCCGGCAAGAC-CATCCTGGACTTCCTGAAGTCCGACGGCTTCGCCA ACCGGAACTTCATGCAGCTGATCCACGACGACTCCCTGACCTTCAAGGAGGA-CATCCAGAAGGCCCAGGTGTCCGGCCAGGGCGACTCCCTGCA CGAGCACATCGCCAACCTGGCCGGCTCCCCCGCCATCAAGAAGGGCATCCTGCAGACCGT-GAAGGTGGTGGACGAGCTGGTGAAGGTGATGGGC CGGCACAAGCCCGAGAACATCGTGATCGAGATGGCCCGGGAGAACCAGAC-CACCCAGAAGGGCCAGAAGAACTCCCGGGAGCGGATGAAGCGGA TCGAGGAGGGCATCAAGGAGCTGGGCTCCCAGATCCTGAAGGAGCACCCCGTG-GAGAACACCCAGCTGCAGAACGAGAAGCTGTACCTGTACTA CCTGCAGAACGGCCGGGACATGTACGTGGACCAGGAGCTGGACAT-CAACCGGCTGTCCGACTACGACGTGGACGCCATCGTGCCCCAGTCCTTC CTGAAGGACGACTC-CATCGACAACAAGGTGCTGACCCGGTCCGACAAGAACCGGGGCAAGTCCGACAACGTGCCCTCCGAGGAGGTGGTGAAGA AGATGAAGAACTACTGGCGGCAGCTGCTGAACGCCAAGCTGATCACCCAGCG-GAAGTTCGACAACCTGACCAAGGCCGAGCGGGGCGGCCTGTC CGAGCTGGACAAGGCCGGCTTCATCAAGCGGCAGCTGGTGGAGACCCGGCAGATCAC-CAAGCACGTGGCCCAGATCCTGGACTCCCGGATGAAC ACCAAGTACGACGAGAACGACAAGCTGATCCGGGAGGTGAAGGTGATCACCCTGAAGTC-CAAGCTGGTGTCCGACTTCCGGAAGGACTTCCAGT TCTACAAGGTGCGGGAGATCAACAACTACCACCACGCCCACGACGCCTACCT-GAACGCCGTGGTGGGCACCGCCCTGATCAAGAAGTACCCCAA GCTGGAGTCCGAGTTCGTGTACGGCGACTACAAGGTGTACGACGTGCGGAAGATGATCGC-CAAGTCCGAGCAGGAGATCGGCAAGGCCACCGCC AAGTACTTCTTCTACTCCAACATCATGAACTTCTTCAAGACCGAGATCACCCTGGC-CAACGGCGAGATCCGGAAGCGGCCCCTGATCGAGACCA ACGGCGAGACCGGCGAGATCGTGTGGGACAAGGGCCGGGACTTCGCCACCGTGCG-GAAGGTGCTGTCCATGCCCCAGGTGAACATCGTGAAGAA GACCGAGGTGCAGACCGGCGGCTTCTCCAAGGAGTCCATCCTGCCCAAGCG-GAACTCCGACAAGCTGATCGCCCGGAAGAAGGACTGGGACCCC AAGAAGTACGGCGGCTTCGACTCCCCCACCGTGGCCTACTCCGTGCTGGTGGTGGC-CAAGGTGGAGAAGGGCAAGTCCAAGAAGCTGAAGTCCG TGAAGGAGCTGCTGGGCATCACCATCATGGAGCGGTCCTCCTTCGAAGAAGAACCC-CATCGACTTCCTGGAGGCCAAGGGCTACAAGGAGGTGAA GAAGGACCTGATCATCAAGCTGCCCAAGTACTCCCTGTTCGAGCTGGAGAACGGCCG-GAAGCGGATGCTGGCCTCCGCCGGCGAGCTGCAGAAG GGCAACGAGCTGGCCCTGCCCTCCAAGTACGTGAACTTCCTGTACCTGGCCTCCCAC-TACGAGAAGCTGAAGGGCTCCCCCGAGGACAACGAGC |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
|  | AGAAGCAGCTGTTCGTGGAGCAGCACAAGCACTACCTGGACGAGATCATCGAGCA-GATCTCCGAGTTCTCCAAGCGGGTGATCCTGGCCGACGC CAACCTGGACAAGGTGCTGTCCGCCTACAACAAGCACGGGACAAGCCCATCCGG-GAGCAGGCCGAGAACATCATCCACCTGTTCACCCTGACC AACCTGGGCGCCCCCGCCGCCTTCAAGTACTTCGACACCACCATCGACCGGAAGCGGTA-CACCTCCACCAAGGAGGTGCTGGACGCCACCCTGA TCCACCAGTCCATCACCGGCCTGTACGAGACCCG-GATCGACCTGTCCCAGCTGGGCGGCGACGGCGGCGGCTCCCCCAAGAAGAAGCGGAAGGT GTGA |  |
| dCas9 ORF using low A codons of Table 4, with start and stop codons and no NLS | ATGGACAAGAAGTACTCCATCGGCCTGGCCATCGGCACCAACTCCGTGGGCTGGGCCGT-GATCACCGACGAGTACAAGGTGCCCTCCAAGAAGT TCAAGGTGCTGGGCAACACCGACCGGCACTCCATCAAGAAGAACCT-GATCGGCGCCCTGCTGTTCGACTCCGGCGAGACCGCCGAGGCCACCCG GCTGAAGCGGACCGCCCGGCGGCGGTACACCCGGCGGAAGAACCGGATCTGC-TACCTGCAGGAGATCTTCTCCAACGAGATGGCCAAGGTGGAC GACTCCTTCTTCCACCGGCTGGAGGAGTCCTTCCTGGTGGAG-GAGGACAAGAAGCACGAGCGGCACCCCATCTTCGGCAACATCGTGGACGAGG TGGCCTACCACGAGAAGTACCCCACCATCTACCACCTGCGGAAGAAGCTGGTGGACTC-CACCGACAAGGCCGACCTGCGGCTGATCTACCTGGC CCTGGCCCACATGATCAAGTTCCGGGGCCACTTCCTGATCGAGGGCGACCT-GAACCCCGACAACTCCGACGTGGACAAGCTGTTCATCCAGCTG GTGCAGACCTACAACCAGCTGTTCGAGGAGAACCCCATCAACGCCTCCGGCGTGGACGC-CAAGGCCATCCTGTCCGCCCGGCTGTCCAAGTCCC GGCGGCTGGAGAACCT-GATCGCCCAGCTGCCCGGCGAGAAGAAGAACGGCCTGTTCGGCAACCTGATCGCCCTGTCCCTGGGCCTGACCCCCAA CTTCAAGTCCAACTTCGACCTGGCCGAGGACGCCAAGCTGCAGCTGTCCAAGGACACC-TACGACGACGACCTGGACAACCTGCTGGCCCAGATC GGCGACCAGTACGCCGACCTGTTCCTGGCCGCCAAGAACCTGTCCGACGC-CATCCTGCTGTCCGACATCCTGCGGGTGAACACCGAGATCACCA AGGCCCCCCTGTCCGCCTCCATGATCAAGCGGTACGACGAGCAC-CACCAGGACCTGACCCTGCTGAAGGCCCTGGTGCGGCAGCAGCTGCCCGA GAAGTACAAGGAGATCTTCTTCGACCAGTCCAAGAACGGCTACGCCGGCTA-CATCGACGGCGGCGCCTCCCAGGAGGAGTTCTACAAGTTCATC AAGCCCATCCTGGAGAAGATGGACGGCACCGAGGAGCTGCTGGTGAAGCTGAACCGG-GAGGACCTGCTGCGGAAGCAGCGGACCTTCGACAACG GCTCCATCCCCCACCAGATCCACCTGGGCGAGCTGCACGCCATCCTGCGGCGGCAG-GAGGACTTCTACCCCTTCCTGAAGGACAACGGGACGAGAA GATCGAGAAGATCCTGACCTTCCGGATCCCCTAC-TACGTGGGCCCCCTGGCCCGGGGCAACTCCCCGGTTCGCCTGGATGACCCGGAAGTCCGAG GAGACCATCACCCCCTGGAACTTCGAG-GAGGTGGTGGACAAGGGCGCCTCCGCCCAGTCCTTCATCGAGCGGATGACCAACTTCGACAAGAACC TGCCCAACGAGAAGGTGCTGCCCAAGCACTCCCTGCTGTACGAGTACTTCACCGTGTA-CAACGAGCTGACCAAGGTGAAGTACGTGACCGAGGG CATGCGGAAGCCCGCCTTCCTGTCCGGCGAGCAGAAGAAGGCCATCGTGGACCTGCTGTT-CAAGACCAACCGGAAGGTGACCGTGAAGCAGCTG AAGGAGGACTACTTCAAGAAGATCGAGTGCTTCGACTCCGTGGAGATCTCCGGCGTG-GAGGACCGGTTCAACGCCTCCCTGGGCACCTACCACG ACCTGCTGAAGATCATCAAGGACAAGGACTTCCTGGACAACGAGGAGAACGAGGA-CATCCTGGAGGACATCGTGCTGACCCTGACCCTGTTCGA GGACCGGGAGATGATCGAGGAGCGGCTGAAGACCTACGCCCACCTGTTCGACGACAAGGT-GATGAAGCAGCTGAAGCGGCGGCGGTACACCGGC TGGGGCCGGCTGTCCCGGAAGCTGATCAACGGCATCCGGGACAAGCAGTCCGGCAAGAC-CATCCTGGACTTCCTGAAGTCCGACGGCTTCGCCA ACCGGAACTTCATGCAGCTGATCCACGACGACTCCCTGACCTTCAAGGAGGA-CATCCAGAAGGCCCAGGTGTCCGGCCAGGGCGACTCCCTGCA CGAGCACATCGCCAACCTGGCCGGCTCCCCCGCCATCAAGAAGGGCATCCTGCAGACCGT-GAAGGTGGTGGACGAGCTGGTGAAGGTGATGGGC CGGCACAAGCCCGAGAACATCGTGATCGAGATGGCCCGGGAGAACCAGAC-CACCCAGAAGGGCCAGAAGAACTCCCGGGAGCGGATGAAGCGGA TCGAGGAGGGCATCAAGGAGCTGGGCTCCCAGATCCTGAAGGAGCACCCCGTG-GAGAACACCCAGCTGCAGAACGAGAAGCTGTACCTGTACTA CCTGCAGAACGGCCGGGACATGTACGTGGACCAGGAGCTGGACAT-CAACCGGCTGTCCGACTACGACGTGGACGCCATCGTGCCCCAGTCCTTC CTGAAGGACGACTC-CATCGACAACAAGGTGCTGACCCGGTCCGACAAGAACCGGGGCAAGTCCGACAACGTGCCCTCCGAGGAGGTGGTGAAGA AGATGAAGAACTACTGGCGGCAGCTGCTGAACGCCAAGCTGATCACCCAGCG-GAAGTTCGACAACCTGACCAAGGCCGAGCGGGGCGGCCTGTC CGAGCTGGACAAGGCCGGCTTCATCAAGCGGCAGCTGGTGGAGACCCGGCAGATCAC-CAAGCACGTGGCCCAGATCCTGGACTCCCGGATGAAC ACCAAGTACGACGAGAACGACAAGCTGATCCGGGAGGTGAAGGTGATCACCCTGAAGTC-CAAGCTGGTGTCCGACTTCCGGAAGGACTTCCAGT TCTACAAGGTGCGGGAGATCAACAACTACCACCACGCCCACGACGCCTACCT-GAACGCCGTGGTGGGCACCGCCCTGATCAAGAAGTACCCCAA GCTGGAGTCCGAGTTCGTGTACGGCGACTACAAGGTGTACGACGTGCGGAAGATGATCGC-CAAGTCCGAGCAGGAGATCGGCAAGGCCACCGCC | 118 |

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | AAGTACTTCTTCTACTCCAACATCATGAACTTCTTCAAGACCGAGATCACCCTGGC-<br>CAACGGCGAGATCCGGAAGCGGCCCCTGATCGAGACCA<br>ACGGCGAGACCGGCGAGATCGTGTGGGACAAGGGCCGGGACTTCGCCACCGTGCG-<br>GAAGGTGCTGTCCATGCCCCAGGTGAACATCGTGAAGAA<br>GACCGAGGTGCAGACCGGCGGCTTCTCCAAGGAGTCCATCCTGCCCAAGCG-<br>GAACTCCGACAAGCTGATCGCCCGGAAGAAGGACTGGGACCCC<br>AAGAAGTACGGCGGCTTCGACTCCCCCACCGTGGCCTACTCCGTGCTGGTGGTGGC-<br>CAAGGTGGAGAAGGGCAAGTCCAAGAAGCTGAAGTCCG<br>TGAAGGAGCTGCTGGGCATCACCATCATGGAGCGGTCCTCCTTCGAGAAGAACCC-<br>CATCGACTTCCTGGAGGCCAAGGGCTACAAGGAGGTGAA<br>GAAGGACCTGATCATCAAGCTGCCCAAGTACTCCCTGTTCGAGCTGGAGAACGGCCG-<br>GAAGCGGATGCTGGCCTCCGCCGGCGAGCTGCAGAAG<br>GGCAACGAGCTGGCCCTGCCCTCCAAGTACGTGAACTTCCTGTACCTGGCCTCCCAC-<br>TACGAGAAGCTGAAGGGCTCCCCCGAGGACAACGAGC<br>AGAAGCAGCTGTTCGTGGAGCAGCACAAGCACTACCTGGACGAGATCATCGAGCA-<br>GATCTCCGAGTTCTCCAAGCGGGTGATCCTGGCCGACGC<br>CAACCTGGACAAGGTGCTGTCCGCCTACAACAAGCACCGGGACAAGCCCATCCGG-<br>GAGCAGGCCGAGAACATCATCCACCTGTTCACCCTGACC<br>AACCTGGGCGCCCCCGCCGCCTTCAAGTACTTCGACACCACCATCGACCGGAAGCGGTA-<br>CACCTCCACCAAGGAGGTGCTGGACGCCACCCTGA<br>TCCACCAGTCCATCACCGGCCTGTACGAGACCCGGATCGACCTGTCCCAGCTGGGCGGCGACTGA | |
| dCas9 ORF using low A codons of Table 4, with two C-terminal NLS sequences and start and stop codons | ATGGACAAGAAGTACTCCATCGGCCTGGCCATCGGCACCAACTCCGTGGGCTGGGCCGT-<br>GATCACCGACGAGTACAAGGTGCCCTCCAAGAAGT<br>TCAAGGTGCTGGGCAACACCGACCGGCACTCCATCAAGAAGAACCT-<br>GATCGGCGCCCTGCTGTTCGACTCCGGCGAGACCGCCGAGGCCACCCG<br>GCTGAAGCGGACCGCCCGGCGGCGGTACACCCGGCGGAAGAACCGGATCTGC-<br>TACCTGCAGGAGATCTTCTCCAACGAGATGGCCAAGGTGGAC<br>GACTCCTTCTTCCACCGGCTGGAGGAGTCCTTCCTGGTGGAG-<br>GAGGACAAGAAGCACGAGCGGCACCCCATCTTCGGCAACATCGTGGACGAGG<br>TGGCCTACCACGAGAAGTACCCCACCATCTACCACCTGCGGAAGAAGCTGGTGGACTC-<br>CACCGACAAGGCCGACCTGCGGCTGATCTACCTGGC<br>CCTGGCCCACATGATCAAGTTCCGGGGCCACTTCCTGATCGAGGGCGACCT-<br>GAACCCCGACAACTCCGACGTGGACAAGCTGTTCATCCAGCTG<br>GTGCAGACCTACAACCAGCTGTTCGAGGAGAACCCCATCAACGCCTCCGGCGTGGACGC-<br>CAAGGCCATCCTGTCCGCCCGGCTGTCCAAGTCCC<br>GGCGGCTGGAGAACCT-<br>GATCGCCCAGCTGCCCGGCGAGAAGAAGAACGGCCTGTTCGGCAACCTGATCGCCCTGTCCCTGGGCCTGACCCCCAA<br>CTTCAAGTCCAACTTCGACCTGGCCGAGGACGCCAAGCTGCAGCTGTCCAAGGACACC-<br>TACGACGACGACCTGGACAACCTGCTGGCCCAGATC<br>GGCGACCAGTACGCCGACCTGTTCCTGGCCGCCAAGAACCTGTCCGACGC-<br>CATCCTGCTGTCCGACATCCTGCGGGTGAACACCGAGATCACCA<br>AGGCCCCCCTGTCCGCCTCCATGATCAAGCGGTACGACGAGCAC-<br>CACCAGGACCTGACCCTGCTGAAGGCCCTGGTGCGGCAGCAGCTGCCCGA<br>GAAGTACAAGGAGATCTTCTTCGACCAGTCCAAGAACGGCTACGCCGGCTA-<br>CATCGACGGCGGCGCCTCCCAGGAGGAGTTCTACAAGTTCATC<br>AAGCCCATCCTGGAGAAGATGGACGGCACCGAGGAGCTGCTGGTGAAGCTGAACCGG-<br>GAGGACCTGCTGCGGAAGCAGCGGACCTTCGACAACG<br>GCTCCATCCCCCACCAGATCCACCTGGGCGAGCTGCACGCCATCCTGCGGCGGCAG-<br>GAGGACTTCTACCCCTTCCTGAAGGACAACCGGGAGAA<br>GATCGAGAAGATCCTGACCTTCCGGATCCCCTAC-<br>TACGTGGGCCCCCTGGCCCGGGGCAACTCCCGGTTCGCCTGGATGACCCGGAAGTCCGAG<br>GAGACCATCACCCCCTGGAACTTCGAG-<br>GAGGTGGTGGACAAGGGCGCCTCCGCCCAGTCCTTCATCGAGCGGATGACCAACTTCGACAAGAACC<br>TGCCCAACGAGAAGGTGCTGCCCAAGCACTCCCTGCTGTACGAGTACTTCACCGTGTA-<br>CAACGAGCTGACCAAGGTGAAGTACGTGACCGAGGG<br>CATGCGGAAGCCCGCCTTCCTGTCCGGCGAGCAGAAGAAGGCCATCGTGGACCTGCTGTT-<br>CAAGACCAACCGGAAGGTGACCGTGAAGCAGCTG<br>AAGGAGGACTACTTCAAGAAGATCGAGTGCTTCGACTCCGTGGAGATCTCCGGCGTG-<br>GAGGACCGGTTCAACGCCTCCCTGGGCACCTACCACG<br>ACCTGCTGAAGATCATCAAGGACAAGGACTTCCTGGACAACGAGGAGAACGAGGA-<br>CATCCTGGAGGACATCGTGCTGACCCTGACCCTGTTCGA<br>GGACCGGGAGATGATCGAGGAGCGGCTGAAGACCTACGCCCACCTGTTCGACGACAAGGT-<br>GATGAAGCAGCTGAAGCGGCGGCGGTACACCGGC<br>TGGGGCCGGCTGTCCCGGAAGCTGATCAACGGCATCCGGGACAAGCAGTCCGGCAAGAC-<br>CATCCTGGACTTCCTGAAGTCCGACGGCTTCGCCA<br>ACCGGAACTTCATGCAGCTGATCCACGACGACTCCCTGACCTTCAAGGAGGA-<br>CATCCAGAAGGCCCAGGTGTCCGGCCAGGGCGACTCCCTGCA<br>CGAGCACATCGCCAACCTGGCCGGCTCCCCCGCCATCAAGAAGGGCATCCTGCAGACCGT-<br>GAAGGTGGTGGACGAGCTGGTGAAGGTGATGGGC<br>CGGCACAAGCCCGAGAACATCGTGATCGAGATGGCCCGGGAGAACCAGAC-<br>CACCCAGAAGGGCCAGAAGAACTCCCGGGAGCGGATGAAGCGGA<br>TCGAGGAGGGCATCAAGGAGCTGGGCTCCCAGATCCTGAAGGAGCACCCCGTG-<br>GAGAACACCCAGCTGCAGAACGAGAAGCTGTACCTGTACTA<br>CCTGCAGAACGGCCGGGACATGTACGTGGACCAGGAGCTGGACAT-<br>CAACCGGCTGTCCGACTACGACGTGGACGCCATCGTGCCCCAGTCCTTC | 119 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | CTGAAGGACGACTC-CATCGACAACAAGGTGCTGACCCGGTCCGACAAGAACCGGGGCAAGTCCGACAACGTGCCCTCCGAGGAGGTGGTGAAGA AGATGAAGAACTACTGGCGGCAGCTGCTGAACGCCAAGCTGATCACCCAGCG-GAAGTTCGACAACCTGACCAAGGCCGAGCGGGGCGGCCTGTC CGAGCTGGACAAGGCCGGCTTCATCAAGCGGCAGCTGGTGGAGACCCGGCAGATCAC-CAAGCACGTGGCCCAGATCCTGGACTCCCGGATGAAC ACCAAGTACGACGAGAACGACAAGCTGATCCGGGAGGTGAAGGTGATCACCCTGAAGTC-CAAGCTGGTGTCCGACTTCCGGAAGGACTTCCAGT TCTACAAGGTGCGGGAGATCAACAACTACCACCACGCCCACGACGCCTACCT-GAACGCCGTGGTGGGCACCGCCCTGATCAAGAAGTACCCCAA GCTGGAGTCCGAGTTCGTGTACGGCGACTACAAGGTGTACGACGTGCGGAAGATGATCGC-CAAGTCCGAGCAGGAGATCGGCAAGGCCACCGCC AAGTACTTCTTCTACTCCAACATCATGAACTTCTTCAAGACCGAGATCACCCTGGC-CAACGGCGAGATCCGGAAGCGGCCCCTGATCGAGACCA ACGGCGAGACCGGCGAGATCGTGTGGGACAAGGGCCGGGACTTCGCCACCGTGCG-GAAGGTGCTGTCCATGCCCCAGGTGAACATCGTGAAGAA GACCGAGGTGCAGACCGGCGGCTTCTCCAAGGAGTCCATCCTGCCCAAGCG-GAACTCCGACAAGCTGATCGCCCGGAAGAAGGACTGGGACCCC AAGAAGTACGGCGGCTTCGACTCCCCCACCGTGGCCTACTCCGTGCTGGTGGTGGC-CAAGGTGGAGAAGGGCAAGTCCAAGAAGCTGAAGTCCG TGAAGGAGCTGCTGGGCATCACCATCATGGAGCGGTCCTCCTTCGAGAAGAACCC-CATCGACTTCCTGGAGGCCAAGGGCTACAAGGAGGTGAA GAAGGACCTGATCATCAAGCTGCCCAAGTACTCCCTGTTCGAGCTGGAGAACGGCCG-GAAGCGGATGCTGGCCTCCGCCGGCGAGCTGCAGAAG GGCAACGAGCTGGCCCTGCCCTCCAAGTACGTGAACTTCCTGTACCTGGCCTCCCAC-TACGAGAAGCTGAAGGGCTCCCCCGAGGACAACGAGC AGAAGCAGCTGTTCGTGGAGCAGCACAAGCACTACCTGGACGAGATCATCGAGCA-GATCTCCGAGTTCTCCAAGCGGGTGATCCTGGCCGACGC CAACCTGGACAAGGTGCTGTCCGCCTACAACAAGCACCGGGACAAGCCCATCCGG-GAGCAGGCCGAGAACATCATCCACCTGTTCACCCTGACC AACCTGGGCGCCCCCGCCGCCTTCAAGTACTTCGACACCACCATCGACCGGAAGCGGTA-CACCTCCACCAAGGAGGTGCTGGACGCCACCCTGA TCCACCAGTCCATCACCGGCCTGTACGAGACCCG-GATCGACCTGTCCCAGCTGGGCGGCGACGGCTCCGGCTCCCCCAAGAAGAAGCGGAAGGT GGACGGCTCCCCCAAGAAGAAGCGGAAGGTGGACTCCGGCTGA | |
| Cas9 ORF using low A/U codons of Table 4, with two C-terminal NLS sequences and start and stop | ATGGACAAGAAGTACAGCATCGGCCTGGACATCGGCACCAACAGCGTGGGCTGGGCCGT-GATCACCGACGAGTACAAGGTGCCCAGCAAGAAGT TCAAGGTGCTGGGCAACACCGACCGGCACAGCATCAAGAAGAACCT-GATCGGCGCCCTGCTGTTCGACAGCGGCGAGACCGCCGAGGCCACCCG GCTGAAGCGGACCGCCCGGCGGCGGTACACCCGGCGGAAGAACCGGATCTGC-TACCTGCAGGAGATCTTCAGCAACGAGATGGCCAAGGTGGAC GACAGCTTCTTCCACCGGCTGGAGGAGAGCTTCCTGGTGGAG-GAGGACAAGAAGCACGAGCGGCACCCCATCTTCGGCAACATCGTGGACGAGG TGGCCTACCACGAGAAGTACCCCACCATCTACCACCTGCGC-GAAGAAGCTGGTGGACAGCACCGACAAGGCCGACCTGCGGCTGATCTACCTGGC CCTGGCCCACATGATCAAGTTCCGGGGCCACTTCCTGATCGAGGGCGACCT-GAACCCCGACAACAGCGACGTGGACAAGCTGTTCATCCAGCTG GTGCAGACCTACAACCAGCTGTTCGAGGAGAACCCCATCAACGCCAGCGGCGTGGACGC-CAAGGCCATCCTGAGCGCCCGGCTGAGCAAGAGCC GGCGGCTGGAGAACCT-GATCGCCCAGCTGCCCGGCGAGAAGAAGAACGGCCTGTTCGGCAACCTGATCGCCCTGAGCCTGGGCCTGACCCCCAA CTTCAAGAGCAACTTCGACCTGGCCGAGGACGCCAAGCTGCAGCTGAGCAAGGACACC-TACGACGACGACCTGGACAACCTGCTGGCCCAGATC GGCGACCAGTACGCCGACCTGTTCCTGGCCGCCAAGAACCTGAGCGACGCCATCCTGCT-GAGCGACATCCTGCGGGTGAACACCGAGATCACCA AGGCCCCCCTGAGCGCCAGCATGATCAAGCGGTACGACGAGCAC-CACCAGGACCTGACCCTGCTGAAGGCCCTGGTGCGGCAGCAGCTGCCCGA GAAGTACAAGGAGATCTTCTTCGACCAGAGCAAGAACGGCTACGCCGGCTA-CATCGACGGCGGCGCCAGCCAGGAGGAGTTCTACAAGTTCATC AAGCCCATCCTGGAGAAGATGGACGGCACCGAGGAGCTGCTGGTGAAGCTGAACGG-GAGGACCTGCTGCGGAAGCAGCGGACCTTCGACAACG GCAGCATCCCCCACCAGATCCACCTGGGCGAGCTGCACGCCATCCTGCGGCGGCAG-GAGGACTTCTACCCCTTCCTGAAGGACAACCGGGAGAA GATCGAGAAGATCCTGACCTTCCGGATCCCCTAC-TACGTGGGCCCCCTGGCCCGGGGCAACAGCCGGTTCGCCTGGATGACCCGGAAGAGCGAG GAGACCATCACCCCCTGGAACTTCGAG-GAGGTGGTGGACAAGGGCGCCAGCGCCCAGAGCTTCATCGAGCGGATGACCAACTTCGACAAGAACC TGCCCAACGAGAAGGTGCTGCCCAAGCACAGCCTGCTGTACGAGTACTTCACCGTGTA-CAACGAGCTGACCAAGGTGAAGTACGTGACCGAGGG CATGCGGAAGCCCGCCTTCCTGAGCGGCGAGCAGAAGAAGGCCATCGTGGACCTGCTGTT-CAAGACCAACCGGAAGGTGACCGTGAAGCAGCTG AAGGAGGACTACTTCAAGAAGATCGAGTGCTTCGACAGCGTGGAGATCAGCGGCGTG-GAGGACCGGTTCAACGCCAGCCTGGGCACCTACCACG ACCTGCTGAAGATCATCAAGGACAAGGACTTCCTGGACAACGAGGAGAACGAGGA-CATCCTGGAGGACATCGTGCTGACCCTGACCCTGTTCGA | 120 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| codons | GGACCGGGAGATGATCGAGGAGCGGCTGAAGACCTACGCCCACCTGTTCGACGACAAGGT-GATGAAGCAGCTGAAGCGGCGGCGGTACACCGGC TGGGGCCGGCTGAGCCGGAAGCTGATCAACGGCATCCGGGACAAGCAGAGCGGCAAGAC-CATCCTGGACTTCCTGAAGAGCGACGGCTTCGCCA ACCGGAACTTCATGCAGCTGATCCACGACGACAGCCTGACCTTCAAGGAGGA-CATCCAGAAGGCCCAGGTGAGCGGCCAGGGCGACAGCCTGCA CGAGCACATCGCCAACCTGGCCGGCAGCCCCGCCATCAAGAAGGGCATCCTGCAGACCGT-GAAGGTGGTGGACGAGCTGGTGAAGGTGATGGGC CGGCACAAGCCCGAGAACATCGTGATCGAGATGGCCCGGGAGAACCAGAC-CACCCAGAAGGGCCAGAAGAACAGCCGGGAGCGGATGAAGCGGA TCGAGGAGGGCATCAAGGAGCTGGGCAGCCAGATCCTGAAGGAGCACCCCGTG-GAGAACACCCAGCTGCAGAACGAGAAGCTGTACCTGTACTA CCTGCAGAACGGCCGGGACATGTACGTGGACCAGGAGCTGGACATCAACCGGCT-GAGCGACTACGACGTGGACCACATCGTGCCCCAGAGCTTC CTGAAGGACGACAGCATCGACAACAAGGTGCTGACCCG-GAGCGACAAGAACCGGGGCAAGAGCGACAACGTGCCCAGCGAGGAGGTGGTGAAGA AGATGAAGAACTACTGGCGGCAGCTGCTGAACGCCAAGCTGATCACCCAGCG-GAAGTTCGACAACCTGACCAAGGCCGAGCGGGGCGGCCTGAG CGAGCTGGACAAGGCCGGCTTCATCAAGCGGCAGCTGGTGGAGACCCGGCAGATCAC-CAAGCACGTGGCCCAGATCCTGGACAGCCGGATGAAC ACCAAGTACGACGAGAACGACAAGCTGATCCGGGAGGTGAAGGTGATCACCCT-GAAGAGCAAGCTGGTGAGCGACTTCCGGAAGGACTTCCAGT TCTACAAGGTGCGGGAGATCAACAACTACCACCACGCCCACGACGCCTACCT-GAACGCCGTGGTGGGCACCGCCCTGATCAAGAAGTACCCCAA GCTGGAGAGCGAGTTCGTGTACGGCGACTACAAGGTGTACGACGTGCGGAAGATGATCGC-CAAGAGCGAGCAGGAGATCGGCAAGGCCACCGCC AAGTACTTCTTCTACAGCAACATCATGAACTTCTTCAAGACCGAGATCACCCTGGC-CAACGGCGAGATCCGGAAGCGGCCCCTGATCGAGACCA ACGGCGAGACCGGCGAGATCGTGTGGGACAAGGGCCGGGACTTCGCCACCGTGCG-GAAGGTGCTGAGCATGCCCCAGGTGAACATCGTGAAGAA GACCGAGGTGCAGACCGGCGGCTTCAGCAAGGAGAGCATCCTGCCCAAGCG-GAACAGCGACAAGCTGATCGCCCGGAAGAAGGACTGGGACCCC AAGAAGTACGGCGGCTTCGACAGCCCCACCGTGGCCTACAGCGTGCTGGTGGTGGC-CAAGGTGGAGAAGGGCAAGAGCAAGAAGCTGAAGAGCG TGAAGGAGCTGCTGGGCATCACCATCATGGAGCGGAGCAGCTTCGAGAAGAACCC-CATCGACTTCCTGGAGGCCAAGGGCTACAAGGAGGTGAA GAAGGACCTGATCATCAAGCTGCCCAAGTACAGCCTGTTCGAGCTGGAGAACGGCCG-GAAGCGGATGCTGGCCAGCGCCGGCGAGCTGCAGAAG GGCAACGAGCTGGCCCTGCCCAGCAAGTACGTGAACTTCCTGTACCTGGCCAGCCAC-TACGAGAAGCTGAAGGGCAGCCCCGAGGACAACGAGC AGAAGCAGCTGTTCGTGGAGCAGCACAAGCACTACCTGGACGAGATCATCGAGCA-GATCAGCGAGTTCAGCAAGCGGGTGATCCTGGCCGACGC CAACCTGGACAAGGTGCTGAGCGCCTACAACAAGCACCGGGACAAGCCCATCCGG-GAGCAGGCCGAGAACATCATCCACCTGTTCACCCTGACC AACCTGGGCGCCCCCGCCGCCTTCAAGTACTTCGACACCACCATCGACCGGAAGCGGTA-CACCAGCACCAAGGAGGTGCTGGACGCCACCCTGA TCCACCAGAGCATCACCGGCCTGTACGAGACCCGGATCGACCT-GAGCCAGCTGGGCGGCGACGGCAGCGGCAGCCCCAAGAAGAAGCGGAAGGT GGACGGCAGCCCCAAGAAGAAGCGGAAGGTGGACAGCGGCTGA | |
| Cas9 ORF using low A/U codons of Table 4, with start and stop | ATGGACAAGAAGTACAGCATCGGCCTGGACATCGGCACCAACAGCGTGGGCTGGGCCGT-GATCACCGACGAGTACAAGGTGCCCAGCAAGAAGT TCAAGGTGCTGGGCAACACCGACCGGCACAGCATCAAGAAGAACCT-GATCGGCGCCCTGCTGTTCGACAGCGGCGAGACCGCCGAGGCCACCCG GCTGAAGCGGACCGCCCGGCGGCGGTACACCCGGCGGAAGAACCGGATCTGC-TACCTGCAGGAGATCTTCAGCAACGAGATGGCCAAGGTGGAC GACAGCTTCTTCCACCGGCTGGAGGAGAGCTTCCTGGTGGAG-GAGGACAAGAAGCACGAGCGGCACCCCATCTTCGGCAACATCGTGGACGAGG TGGCCTACCACGAGAAGTACCCCACCATCTACCACCTGCGC-GAAGAAGCTGGTGGACAGCACCGACAAGGCCGACCTGCGGCTGATCTACCTGGCC CCTGGCCCACATGATCAAGTTCCGGGGCCACTTCCTGATCGAGGGCGACCT-GAACCCCGACAACAGCGACGTGGACAAGCTGTTCATCCAGCTG GTGCAGACCTACAACCAGCTGTTCGAGGAGAACCCCATCAACGCCAGCGGCGTGGACGC-CAAGGCCATCCTGAGCGCCCGGCTGAGCAAGAGCC GGCGGCTGGAGAACCT-GATCGCCCAGCTGCCCGGCGAGAAGAAGAACGGCCTGTTCGGCAACCTGATCGCCCTGAGCCTGGGCCTGACCCCCAA CTTCAAGAGCAACTTCGACCTGGCCGAGGACGCCAAGCTGCAGCTGAGCAAGGACACC-TACGACGACGACCTGGACAACCTGCTGGCCCAGATC GGCGACCAGTACGCCGACCTGTTCCTGGCCGCCAAGAACCTGAGCGACGCCATCCTGCT-GAGCGACATCCTGCGGGTGAACACCGAGATCACCA AGGCCCCCCTGAGCGCCAGCATGATCAAGCGGTACGACGAGCAC-CACCAGGACCTGACCCTGCTGAAGGCCCTGGTGCGGCAGCAGCTGCCCGA GAAGTACAAGGAGATCTTCTTCGACCAGAGCAAGAACGGCTACGCCGGCTA-CATCGACGGCGGCGCCAGCCAGGAGGAGTTCTACAAGTTCATC AAGCCCATCCTGGAGAAGATGGACGGCACCGAGGAGCTGCTGGTGAAGCTGAACCGG-GAGGACCTGCTGCGGAAGCAGCGGACCTTCGACAACG | 121 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| codons and no NLS | GCAGCATCCCCCACCAGATCCACCTGGGCGAGCTGCACGCCATCCTGCGGCGGCAG-GAGGACTTCTACCCCTTCCTGAAGGACAACCGGGAGAAGATCGAGAAGATCCTGACCTTCCGGATCCCCTAC-TACGTGGGCCCCCTGGCCCGGGGCAACAGCCGGTTCGCCTGGATGACCCGGAAGAGCGAGGAGACCATCACCCCCTGGAACTTCGAG-GAGGTGGTGGACAAGGGCGCCAGCGCCCAGAGCTTCATCGAGCGGATGACCAACTTCGACAAGAACCTGCCCAACGAGAAGGTGCTGCCCAAGCACAGCCTGCTGTACGAGTACTTCACCGTGTA-CAACGAGCTGACCAAGGTGAAGTACGTGACCGAGGGCATGCGGAAGCCCGCCTTCCTGAGCGGCGAGCAGAAGAAGGCCATCGTGGACCTGCTGTT-CAAGACCAACCGGAAGGTGACCGTGAAGCAGCTGAAGGAGGACTACTTCAAGAAGATCGAGTGCTTCGACAGCGTGGAGATCAGCGGCGTG-GAGGACCGGTTCAACGCCAGCCTGGGCACCTACCACGACCTGCTGAAGATCATCAAGGACAAGGACTTCCTGGACAACGAGGAGAACGAGGA-CATCCTGGAGGACATCGTGCTGACCCTGACCCTGTTCGAGGACCGGGAGATGATCGAGGAGCGGCTGAAGACCTACGCCCACCTGTTCGACGACAAGGT-GATGAAGCAGCTGAAGCGGCGGCGGTACACCGGCTGGGGCCGGCTGAGCCGGAAGCTGATCAACGGCATCCGGGACAAGCAGAGCGGCAAGAC-CATCCTGGACTTCCTGAAGAGCGACGGCTTCGCCAACCGGAACTTCATGCAGCTGATCCACGACGACAGCCTGACCTTCAAGGAGGA-CATCCAGAAGGCCCAGGTGAGCGGCCAGGGCGACAGCCTGCACGAGCACATCGCCAACCTGGCCGGCAGCCCCGCCATCAAGAAGGGCATCCTGCAGACCGT-GAAGGTGGTGGACGAGCTGGTGAAGGTGATGGGCCGGCACAAGCCCGAGAACATCGTGATCGAGATGGCCCGGGAGAACCAGAC-CACCCAGAAGGGCCAGAAGAACAGCCGGGAGCGGATGAAGCGGATCGAGGAGGGCATCAAGGAGCTGGGCAGCCAGATCCTGAAGGAGCACCCCGTG-GAGAACACCCAGCTGCAGAACGAGAAGCTGTACCTGTACTACCTGCAGAACGGCCGGGACATGTACGTGGACCAGGAGCTGGACATCAACCGGCT-GAGCGACTACGACGTGGACCACATCGTGCCCCAGAGCTTCCTGAAGGACGACAGCATCGACAACAAGGTGCTGACCCG-GAGCGACAAGAACCGGGGCAAGAGCGACAACGTGCCCAGCGAGGAGGTGGTGAAGAAGATGAAGAACTACTGGCGGCAGCTGCTGAACGCCAAGCTGATCACCCAGCG-GAAGTTCGACAACCTGACCAAGGCCGAGCGGGGCGGCCTGAGCGAGCTGGACAAGGCCGGCTTCATCAAGCGGCAGCTGGTGGAGACCCGGCAGATCAC-CAAGCACGTGGCCCAGATCCTGGACAGCCGGATGAACACCAAGTACGACGAGAACGACAAGCTGATCCGGGAGGTGAAGGTGATCACCCT-GAAGAGCAAGCTGGTGAGCGACTTCCGGAAGGACTTCCAGTTCTACAAGGTGCGGGAGATCAACAACTACCACCACGCCCACGACGCCTACCT-GAACGCCGTGGTGGGCACCGCCCTGATCAAGAAGTACCCCAAGCTGGAGAGCGAGTTCGTGTACGGCGACTACAAGGTGTACGACGTGCGGAAGATGATCGC-CAAGAGCGAGCAGGAGATCGGCAAGGCCACCGCCAAGTACTTCTTCTACAGCAACATCATGAACTTCTTCAAGACCGAGATCACCCTGGC-CAACGGCGAGATCCGGAAGCGGCCCCTGATCGAGACCAACGGCGAGACCGGCGAGATCGTGTGGGACAAGGGCCGGGACTTCGCCACCGTGCG-GAAGGTGCTGAGCATGCCCCAGGTGAACATCGTGAAGAAGACCGAGGTGCAGACCGGCGGCTTCAGCAAGGAGAGCATCCTGCCCAAGCG-GAACAGCGACAAGCTGATCGCCCGGAAGAAGGACTGGGACCCCAAGAAGTACGGCGGCTTCGACAGCCCCACCGTGGCCTACAGCGTGCTGGTGGTGGC-CAAGGTGGAGAAGGGCAAGAGCAAGAAGCTGAAGAGCGTGAAGGAGCTGCTGGGCATCACCATCATGGAGCGGAGCAGCTTCGAGAAGAACCC-CATCGACTTCCTGGAGGCCAAGGGCTACAAGGAGGTGAAGAAGGACCTGATCATCAAGCTGCCCAAGTACAGCCTGTTCGAGCTGGAGAACGGCCG-GAAGCGGATGCTGGCCAGCGCCGGCGAGCTGCAGAAGGGCAACGAGCTGGCCCTGCCCAGCAAGTACGTGAACTTCCTGTACCTGGCCAGCCAC-TACGAGAAGCTGAAGGGCAGCCCCGAGGACAACGAGCAGAAGCAGCTGTTCGTGGAGCAGCACAAGCACTACCTGGACGAGATCATCGAGCA-GATCAGCGAGTTCAGCAAGCGGGTGATCCTGGCCGACGCCAACCTGGACAAGGTGCTGAGCGCCTACAACAAGCACCGGGACAAGCCCATCCGG-GAGCAGGCCGAGAACATCATCCACCTGTTCACCCTGACCAACCTGGGCGCCCCCGCCGCCTTCAAGTACTTCGACACCACCATCGACCGGAAGCGGTA-CACCAGCACCAAGGAGGTGCTGGACGCCACCCTGATCCACCAGAGCATCACCGGCCTGTACGAGACCCGGATCGACCTGAGCCAGCTGGGCGGCGACTGA | |
| Cas9 nickase ORF using low A/U codons | ATGGACAAGAAGTACAGCATCGGCCTGGCCATCGGCACCAACAGCGTGGGCTGGGCCGT-GATCACCGACGAGTACAAGGTGCCCAGCAAGAAGTTCAAGGTGCTGGGCAACACCGACCGGCACAGCATCAAGAAGAACCT-GATCGGCGCCCTGCTGTTCGACAGCGGCGAGACCGCCGAGGCCACCCGGCTGAAGCGGACCGCCCGGCGGCGGTACACCCGGCGGAAGAACCGGATCTGC-TACCTGCAGGAGATCTTCAGCAACGAGATGGCCAAGGTGGACGACAGCTTCTTCCACCGGCTGGAGGAGAGCTTCCTGGTGGAG-GAGGACAAGAAGCACGAGCGGCACCCCATCTTCGGCAACATCGTGGACGAGGTGGCCTACCACGAGAAGTACCCCACCATCTACCACCTGCGC-GAAGAAGCTGGTGGACAGCACCGACAAGGCCGACCTGCGGCTGATCTACCTGGCCCTGGCCCACATGATCAAGTTCCGGGGCCACTTCCTGATCGAGGGCGACCT-GAACCCCGACAACAGCGACGTGGACAAGCTGTTCATCCAGCTGGTGCAGACCTACAACCAGCTGTTCGAGGAGAACCCCATCAACGCCAGCGGCGTGGACGC-CAAGGCCATCCTGAGCGCCCGGCTGAGCAAGAGCC | 122 |

| Description | Sequence | SEQ ID No. |
|---|---|---|
| of Table 4, with start and stop codons | GGCGGCTGGAGAACCT-GATCGCCCAGCTGCCCGGCGAGAAGAAGAACGGCCTGTTCGGCAACCTGATCGCCCTGAGCCTGGGCCTGACCCCCAA CTTCAAGAGCAACTTCGACCTGGCCGAGGACGCCAAGCTGCAGCTGAGCAAGGACACC-TACGACGACGACCTGGACAACCTGCTGGCCCAGATC GGCGACCAGTACGCCGACCTGTTCCTGGCCGCCAAGAACCTGAGCGACGCCATCCTGCT-GAGCGACATCCTGCGGGTGAACACCGAGATCACCA AGGCCCCCCTGAGCGCCAGCATGATCAAGCGGTACGACGAGCAC-CACCAGGACCTGACCCTGCTGAAGGCCCTGGTGCGGCAGCAGCTGCCCGA GAAGTACAAGGAGATCTTCTTCGACCAGAGCAAGAACGGCTACGCCGGCTA-CATCGACGGCGGCGCCAGCCAGGAGGAGTTCTACAAGTTCATC AAGCCCATCCTGGAGAAGATGGACGGCACCGAGGAGCTGCTGGTGAAGCTGAACCGG-GAGGACCTGCTGCGGAAGCAGCGGACCTTCGACAACG GCAGCATCCCCCACCAGATCCACCTGGGCGAGCTGCACGCCATCCTGCGGCGGCAG-GAGGACTTCTACCCCTTCCTGAAGGACAACCGGGAGAA GATCGAGAAGATCCTGACCTTCCGGATCCCCTAC-TACGTGGGCCCCCTGGCCCGGGGCAACAGCCGGTTCGCCTGGATGACCCGGAAGAGCGAG GAGACCATCACCCCCTGGAACTTCGAG-GAGGTGGTGGACAAGGGCGCCAGCGCCCAGAGCTTCATCGAGCGGATGACCAACTTCGACAAGAACC TGCCCAACGAGAAGGTGCTGCCCAAGCACAGCCTGCTGTACGAGTACTTCACCGTGTA-CAACGAGCTGACCAAGGTGAAGTACGTGACCGAGGG CATGCGGAAGCCCGCCTTCCTGAGCGGCGAGCAGAAGAAGGCCATCGTGGACCTGCTGTT-CAAGACCAACCGGAAGGTGACCGTGAAGCAGCTG AAGGAGGACTACTTCAAGAAGATCGAGTGCTTCGACAGCGTGGAGATCAGCGGCGTG-GAGGACCGGTTCAACGCCAGCCTGGGCACCTACCACG ACCTGCTGAAGATCATCAAGGACAAGGACTTCCTGGACAACGAGGAGAACGAGGA-CATCCTGGAGGACATCGTGCTGACCCTGACCCTGTTCGA GGACCGGGAGATGATCGAGGAGCGGCTGAAGACCTACGCCCACCTGTTCGACGACAAGGT-GATGAAGCAGCTGAAGCGGCGGCGGTACACCGGC TGGGGCCGGCTGAGCCGGAAGCTGATCAACGGCATCCGGGACAAGCAGAGCGGCAAGAC-CATCCTGGACTTCCTGAAGAGCGACGCCTTCGCCA ACCGGAACTTCATGCAGCTGATCCACGACGACAGCCTGACCTTCAAGGAGGA-CATCCAGAAGGCCCAGGTGAGCGGCCAGGGCGACAGCCTGCA CGAGCACATCGCCAACCTGGCCGGCAGCCCCGCCATCAAGAAGGGCATCCTGCAGACCGT-GAAGGTGGTGGACGAGCTGGTGAAGGTGATGGGC CGGCACAAGCCCGAGAACATCGTGATCGAGATGGCCCGGGAGAACCAGAC-CACCCAGAAGGGCCAGAAGAACAGCCGGGAGCGGATGAAGCGGA TCGAGGAGGGCATCAAGGAGCTGGGCAGCCAGATCCTGAAGGAGCACCCCGTG-GAGAACACCCAGCTGCAGAACGAGAAGCTGTACCTGTACTA CCTGCAGAACGGCCGGGACATGTACGTGGACCAGGAGCTGGACATCAACCGGCT-GAGCGACTACGACGTGGACCACATCGTGCCCCAGAGCTTC CTGAAGGACGACAGCATCGACAACAAGGTGCTGACCCG-GAGCGACAAGAACCGGGGCAAGAGCGACAACGTGCCCAGCGAGGAGGTGGTGAAGA AGATGAAGAACTACTGGCGGCAGCTGCTGAACGCCAAGCTGATCACCCAGCG-GAAGTTCGACAACCTGACCAAGGCCGAGCGGGGCGGCCTGAG CGAGCTGGACAAGGCCGGCTTCATCAAGCGGCAGCTGGTGGAGACCCGGCAGATCAC-CAAGCACGTGGCCCAGATCCTGGACAGCCGGATGAAC ACCAAGTACGACGAGAACGACAAGCTGATCCGGGAGGTGAAGGTGATCACCCT-GAAGAGCAAGCTGGTGAGCGACTTCCGGAAGGACTTCCAGT TCTACAAGGTGCGGGAGATCAACAACTACCACCACGCCCACGACGCCTACCT-GAACGCCGTGGTGGGCACCGCCCTGATCAAGAAGTACCCCAA GCTGGAGAGCGAGTTCGTGTACGGCGACTACAAGGTGTACGACGTGCGGAAGATGATCGC-CAAGAGCGAGCAGGAGATCGGCAAGGCCACCGCC AAGTACTTCTTCTACAGCAACATCATGAACTTCTTCAAGACCGAGATCACCCTGGC-CAACGGCGAGATCCGGAAGCGGCCCCTGATCGAGACCA ACGGCGAGACCGGCGAGATCGTGTGGGACAAGGGCCGGGACTTCGCCACCGTGCG-GAAGGTGCTGAGCATGCCCCAGGTGAACATCGTGAAGAA GACCGAGGTGCAGACCGGCGGCTTCAGCAAGGAGAGCATCCTGCCCAAGCG-GAACAGCGACAAGCTGATCGCCCGGAAGAAGGACTGGGACCCC AAGAAGTACGGCGGCTTCGACAGCCCCACCGTGGCCTACAGCGTGCTGGTGGTGGC-CAAGGTGGAGAAGGGCAAGAGCAAGAAGCTGAAGAGCG TGAAGGAGCTGCTGGGCATCACCATCATGGAGCGGAGCAGCTTCGAGAAGAACCC-CATCGACTTCCTGGAGGCCAAGGGCTACAAGGAGGTGAA GAAGGACCTGATCATCAAGCTGCCCAAGTACAGCCTGTTCGAGCTGGAGAACGGCCG-GAAGCGGATGCTGGCCAGCGCCGGCGAGCTGCAGAAG GGCAACGAGCTGGCCCTGCCCAGCAAGTACGTGAACTTCCTGTACCTGGCCAGCCAC-TACGAGAAGCTGAAGGGCAGCCCCGAGGACAACGAGC AGAAGCAGCTGTTCGTGGAGCAGCACAAGCACTACCTGGACGAGATCATCGAGCA-GATCAGCGAGTTCAGCAAGCGGGTGATCCTGGCCGACGC CAACCTGGACAAGGTGCTGAGCGCCTACAACAAGCACCGGGACAAGCCCATCCGG-GAGCAGGCCGAGAACATCATCCACCTGTTCACCCTGACC AACCTGGGCGCCCCCGCCGCCTTCAAGTACTTCGACACCACCATCGACCGGAAGCGGTA-CACCAGCACCAAGGAGGTGCTGGACGCCACCCTGA TCCACCAGAGCATCACCGGCCTGTACGAGACCCGGATCGACCT-GAGCCAGCTGGGCGGCGACGGCGGCGGCAGCCCCAAGAAGAAGCGGAAGGT GTGA | |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| Cas9 nickase ORF using low A/U codons of Table 4, with two C-terminal NLS sequences and start and stop codons | ATGGACAAGAAGTACAGCATCGGCCTGGCCATCGGCACCAACAGCGTGGGCTGGGCCGT-GATCACCGACGAGTACAAGGTGCCCAGCAAGAAGT TCAAGGTGCTGGGCAACACCGACCGGCACAGCATCAAGAAGAACCT-GATCGGCGCCCTGCTGTTCGACAGCGGCGAGACCGCCGAGGCCACCCG GCTGAAGCGGACCGCCCGGCGGCGGTACACCCGGCGGAAGAACCGGATCTGC-TACCTGCAGGAGATCTTCAGCAACGAGATGGCCAAGGTGGAC GACAGCTTCTTCCACCGGCTGGAGGAGAGCTTCCTGGTGGAG-GAGGACAAGAAGCACGAGCGGCACCCCATCTTCGGCAACATCGTGGACGAGG TGGCCTACCACGAGAAGTACCCCACCATCTACCACCTGCG-GAAGAAGCTGGTGGACAGCACCGACAAGGCCGACCTGCGGCTGATCTACCTGGC CCTGGCCCACATGATCAAGTTCCGGGGCCACTTCCTGATCGAGGGCGACCT-GAACCCCGACAACAGCGACGTGGACAAGCTGTTCATCCAGCTG GTGCAGACCTACAACCAGCTGTTCGAGGAGAACCCCATCAACGCCAGCGGCGTGGACGC-CAAGGCCATCCTGAGCGCCCGGCTGAGCAAGAGCC GGCGGCTGGAGAACCT-GATCGCCCAGCTGCCCGGCGAGAAGAAGAACGGCCTGTTCGGCAACCTGATCGCCCTGAGCCTGGGCCTGACCCCCAA CTTCAAGAGCAACTTCGACCTGGCCGAGGACGCCAAGCTGCAGCTGAGCAAGGACACC-TACGACGACGACCTGGACAACCTGCTGGCCCAGATC GGCGACCAGTACGCCGACCTGTTCCTGGCCGCCAAGAACCTGAGCGACGCCATCCTGCT-GAGCGACATCCTGCGGGTGAACACCGAGATCACCA AGGCCCCCCTGAGCGCCAGCATGATCAAGCGGTACGACGAGCAC-CACCAGGACCTGACCCTGCTGAAGGCCCTGGTGCGGCAGCAGCTGCCCGA GAAGTACAAGGAGATCTTCTTCGACCAGAGCAAGAACGGCTACGCCGGCTA-CATCGACGGCGGCGCCAGCCAGGAGGAGTTCTACAAGTTCATC AAGCCCATCCTGGAGAAGATGGACGGCACCGAGGAGCTGCTGGTGAAGCTGAACCGG-GAGGACCTGCTGCGGAAGCAGCGGACCTTCGACAACG GCAGCATCCCCCACCAGATCCACCTGGGCGAGCTGCACGCCATCCTGCGGCGGCAG-GAGGACTTCTACCCCTTCCTGAAGGACAACCGGGAGAA GATCGAGAAGATCCTGACCTTCCGGATCCCCTAC-TACGTGGGCCCCCTGGCCCGGGGCAACAGCCGGTTCGCCTGGATGACCCGGAAGAGCGAG GAGACCATCACCCCCTGGAACTTCGAG-GAGGTGGTGGACAAGGGCGCCAGCGCCCAGAGCTTCATCGAGCGGATGACCAACTTCGACAAGAACC TGCCCAACGAGAAGGTGCTGCCCAAGCACAGCCTGCTGTACGAGTACTTCACCGTGTA-CAACGAGCTGACCAAGGTGAAGTACGTGACCGAGGG CATGCGGAAGCCCGCCTTCCTGAGCGGCGAGCAGAAGAAGGCCATCGTGGACCTGCTGTT-CAAGACCAACCGGAAGGTGACCGTGAAGCAGCTG AAGGAGGACTACTTCAAGAAGATCGAGTGCTTCGACAGCGTGGAGATCAGCGGCGTG-GAGGACCGGTTCAACGCCAGCCTGGGCACCTACCACG ACCTGCTGAAGATCATCAAGGACAAGGACTTCCTGGACAACGAGGAGAACGAGGA-CATCCTGGAGGACATCGTGCTGACCCTGACCCTGTTCGA GGACCGGGAGATGATCGAGGAGCGGCTGAAGACCTACGCCCACCTGTTCGACGACAAGGT-GATGAAGCAGCTGAAGCGGCGGCGGTACACCGGC TGGGGCCGGCTGAGCCGGAAGCTGATCAACGGCATCCGGGACAAGCAGAGCGGCAAGAC-CATCCTGGACTTCCTGAAGAGCGACGGCTTCGCCA ACCGGAACTTCATGCAGCTGATCCACGACGACAGCCTGACCTTCAAGGAGGA-CATCCAGAAGGCCCAGGTGAGCGGCCAGGGCGACAGCCTGCA CGAGCACATCGCCAACCTGGCCGGCAGCCCCGCCATCAAGAAGGGCATCCTGCAGACCGT-GAAGGTGGTGGACGAGCTGGTGAAGGTGATGGGC CGGCACAAGCCCGAGAACATCGTGATCGAGATGGCCCGGGAGAACCAGAC-CACCCAGAAGGGCCAGAAGAACAGCCGGGAGCGGATGAAGCGGA TCGAGGAGGGCATCAAGGAGCTGGGCAGCCAGATCCTGAAGGAGCACCCCGTG-GAGAACACCCAGCTGCAGAACGAGAAGCTGTACCTGTACTA CCTGCAGAACGGCCGGGACATGTACGTGGACCAGGAGCTGGACATCAACCGGCT-GAGCGACTACGACGTGCACCATCGTGCCCCAGAGCTTC CTGAAGGACGACAGCATCGACAACAAGGTGCTGACCCG-GAGCGACAAGAACCGGGGCAAGAGCGACAACGTGCCCAGCGAGGAGGTGGTGAAGA AGATGAAGAACTACTGGCGGCAGCTGCTGAACGCCAAGCTGATCACCCAGCG-GAAGTTCGACAACCTGACCAAGGCCGAGCGGGGCGGCCTGAG CGAGCTGGACAAGGCCGGCTTCATCAAGCGGCAGCTGGTGGAGACCCGGCAGATCAC-CAAGCACGTGGCCCAGATCCTGGACAGCCGGATGAAC ACCAAGTACGACGAGAACGACAAGCTGATCCGGGAGGTGAAGGTGATCACCCT-GAAGAGCAAGCTGGTGAGCGACTTCCGGAAGGACTTCCAGT TCTACAAGGTGCGGGAGATCAACAACTACCACCACGCCCACGACGCCTACCT-GAACGCCGTGGTGGGCACCGCCCTGATCAAGAAGTACCCCAA GCTGGAGAGCGAGTTCGTGTACGGCGACTACAAGGTGTACGACGTGCGGAAGATGATCGC-CAAGAGCGAGCAGGAGATCGGCAAGGCCACCGCC AAGTACTTCTTCTACAGCAACATCATGAACTTCTTCAAGACCGAGATCACCCTGGC-CAACGGCGAGATCCGGAAGCGGCCCCTGATCGAGACCA ACGGCGAGACCGGCGAGATCGTGTGGGACAAGGGCCGGGACTTCGCCACCGTGCG-GAAGGTGCTGAGCATGCCCCAGGTGAACATCGTGAAGAA GACCGAGGTGCAGACCGGCGGCTTCAGCAAGGAGAGCATCCTGCCCAAGCG-GAACAGCGACAAGCTGATCGCCCGGAAGAAGGACTGGGACCCC AAGAAGTACGGCGGCTTCGACAGCCCCACCGTGGCCTACAGCGTGCTGGTGGTGGC-CAAGGTGGAGAAGGGCAAGAGCAAGAAGCTGAAGAGCG TGAAGGAGCTGCTGGGCATCACCATCATGGAGCGGAGCAGCTTCGAGAAGAACCC-CATCGACTTCCTGGAGGCCAAGGGCTACAAGGAGGTGAA | 123 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | GAAGGACCTGATCATCAAGCTGCCCAAGTACAGCCTGTTCGAGCTGGAGAACGGCCG-<br>GAAGCGGATGCTGGCCAGCGCCGGCGAGCTGCAGAAG<br>GGCAACGAGCTGGCCCTGCCCAGCAAGTACGTGAACTTCCTGTACCTGGCCAGCCAC-<br>TACGAGAAGCTGAAGGGCAGCCCCGAGGACAACGAGC<br>AGAAGCAGCTGTTCGTGGAGCAGCACAAGCACTACCTGGACGAGATCATCGAGCA-<br>GATCAGCGAGTTCAGCAAGCGGGTGATCCTGGCCGACGC<br>CAACCTGGACAAGGTGCTGAGCGCCTACAACAAGCACCGGGACAAGCCCATCCGG-<br>GAGCAGGCCGAGAACATCATCCACCTGTTCACCCTGACC<br>AACCTGGGCGCCCCCGCCGCCTTCAAGTACTTCGACACCACCATCGACCGGAAGCGGTA-<br>CACCAGCACCAAGGAGGTGCTGGACGCCACCCTGA<br>TCCACCAGAGCATCACCGGCCTGTACGAGACCCGGATCGACCT-<br>GAGCCAGCTGGGCGGCGACGGCAGCGGCAGCCCCAAGAAGAAGCGGAAGGT<br>GGACGGCAGCCCCAAGAAGAAGCGGAAGGTGGACAGCGGCTGA | |
| Cas9 nick-<br>ase ORF using low A/U codons of Table 4, with start and stop codons and no NLS | ATGGACAAGAAGTACAGCATCGGCCTGGCCATCGGCACCAACAGCGTGGGCTGGGCCGT-<br>GATCACCGACGAGTACAAGGTGCCCAGCAAGAAGT<br>TCAAGGTGCTGGGCAACACCGACCGGCACAGCATCAAGAAGAACCT-<br>GATCGGCGCCCTGCTGTTCGACAGCGGCGAGACCGCCGAGGCCACCCG<br>GCTGAAGCGGACCGCCCGGCGGCGGTACACCCGGCGGAAGAACCGGATCTGC-<br>TACCTGCAGGAGATCTTCAGCAACGAGATGGCCAAGGTGGAC<br>GACAGCTTCTTCCACCGGCTGGAGGAGAGCTTCCTGGTGGAG-<br>GAGGACAAGAAGCACGAGCGGCACCCCATCTTCGGCAACATCGTGGACGAGG<br>TGGCCTACCACGAGAAGTACCCCACCATCTACCACCTGCG-<br>GAAGAAGCTGGTGGACAGCACCGACAAGGCCGACCTGCGGCTGATCTACCTGGC<br>CCTGGCCCACATGATCAAGTTCCGGGGCCACTTCCTGATCGAGGGCGACCT-<br>GAACCCCGACAACAGCGACGTGGACAAGCTGTTCATCCAGCTG<br>GTGCAGACCTACAACCAGCTGTTCGAGGAGAACCCCATCAACGCCAGCGGCGTGGACGC-<br>CAAGGCCATCCTGAGCGCCCGGCTGAGCAAGAGCC<br>GGCGGCTGGAGAACCT-<br>GATCGCCCAGCTGCCCGGCGAGAAGAAGAACGGCCTGTTCGGCAACCTGATCGCCCTGAGCCTGGGCCTGACCCCCAA<br>CTTCAAGAGCAACTTCGACCTGGCCGAGGACGCCAAGCTGCAGCTGAGCAAGGACACC-<br>TACGACGACGACCTGGACAACCTGCTGGCCCAGATC<br>GGCGACCAGTACGCCGACCTGTTCCTGGCCGCCAAGAACCTGAGCGACGCCATCCTGCT-<br>GAGCGACATCCTGCGGGTGAACACCGAGATCACCA<br>AGGCCCCCCTGAGCGCCAGCATGATCAAGCGGTACGACGAGCAC-<br>CACCAGGACCTGACCCTGCTGAAGGCCCTGGTGCGGCAGCAGCTGCCCGA<br>GAAGTACAAGGAGATCTTCTTCGACCAGAGCAAGAACGGCTACGCCGGCTA-<br>CATCGACGGCGGCGCCAGCCAGGAGGAGTTCTACAAGTTCATC<br>AAGCCCATCCTGGAGAAGATGGACGGCACCGAGGAGCTGCTGGTGAAGCTGAACCGG-<br>GAGGACCTGCTGCGGAAGCAGCGGACCTTCGACAACG<br>GCAGCATCCCCCACCAGATCCACCTGGGCGAGCTGCACGCCATCCTGCGGCGGCAG-<br>GAGGACTTCTACCCCTTCCTGAAGGACAACCGGGAGAA<br>GATCGAGAAGATCCTGACCTTCCGGATCCCCTAC-<br>TACGTGGGCCCCCTGGCCCGGGGCAACAGCCGGTTCGCCTGGATGACCCGGAAGAGCGAG<br>GAGACCATCACCCCCTGGAACTTCGAG-<br>GAGGTGGTGGACAAGGGCGCCAGCGCCCAGAGCTTCATCGAGCGGATGACCAACTTCGACAAGAACC<br>TGCCCAACGAGAAGGTGCTGCCCAAGCACAGCCTGCTGTACGAGTACTTCACCGTGTA-<br>CAACGAGCTGACCAAGGTGAAGTACGTGACCGAGGG<br>CATGCGGAAGCCCGCCTTCCTGAGCGGCGAGCAGAAGAAGGCCATCGTGGACCTGCTGTT-<br>CAAGACCAACCGGAAGGTGACCGTGAAGCAGCTG<br>AAGGAGGACTACTTCAAGAAGATCGAGTGCTTCGACAGCGTGGAGATCAGCGGCGTG-<br>GAGGACCGGTTCAACGCCAGCCTGGGCACCTACCACG<br>ACCTGCTGAAGATCATCAAGGACAAGGACTTCCTGGACAACGAGGAGAACGAGGA-<br>CATCCTGGAGGACATCGTGCTGACCCTGACCCTGTTCGA<br>GGACCGGGAGATGATCGAGGAGCGGCTGAAGACCTACGCCCACCTGTTCGACGACAAGGT-<br>GATGAAGCAGCTGAAGCGGCGGCGGTACACCGGC<br>TGGGGCCGGCTGAGCCGGAAGCTGATCAACGGCATCCGGGACAAGCAGAGCGGCAAGAC-<br>CATCCTGGACTTCCTGAAGAGCGACGGCTTCGCCA<br>ACCGGAACTTCATGCAGCTGATCCACGACGACAGCCTGACCTTCAAGGAGGA-<br>CATCCAGAAGGCCCAGGTGAGCGGCCAGGGCGACAGCCTGCA<br>CGAGCACATCGCCAACCTGGCCGGCAGCCCCGCCATCAAGAAGGGCATCCTGCAGACCGT-<br>GAAGGTGGTGGACGAGCTGGTGAAGGTGATGGGC<br>CGGCACAAGCCCGAGAACATCGTGATCGAGATGGCCCGGGAGAACCAGAC-<br>CACCCAGAAGGGCCAGAAGAACAGCCGGGAGCGGATGAAGCGGA<br>TCGAGGAGGGCATCAAGGAGCTGGGCAGCCAGATCCTGAAGGAGCACCCCGTG-<br>GAGAACACCCAGCTGCAGAACGAGAAGCTGTACCTGTACTA<br>CCTGCAGAACGGCCGGGACATGTACGTGGACCAGGAGCTGGACATCAACCGGCT-<br>GAGCGACTACGACGTGGACCACATCGTGCCCCAGAGCTTC<br>CTGAAGGACGACAGCATCGACAACAAGGTGCTGACCCG-<br>GAGCGACAAGAACCGGGGCAAGAGCGACAACGTGCCCAGCGAGGAGGTGGTGAAGA<br>AGATGAAGAACTACTGGCGGCAGCTGCTGAACGCCAAGCTGATCACCCAGCG-<br>GAAGTTCGACAACCTGACCAAGGCCGAGCGGGGCGGCCTGAG<br>CGAGCTGGACAAGGCCGGCTTCATCAAGCGGCAGCTGGTGGAGACCCGGCAGATCAC-<br>CAAGCACGTGGCCCAGATCCTGGACAGCCGGATGAAC<br>ACCAAGTACGACGAGAACGACAAGCTGATCCGGGAGGTGAAGGTGATCACCCT-<br>GAAGAGCAAGCTGGTGAGCGACTTCCGGAAGGACTTCCAGT | 124 |

| Description | Sequence | SEQ ID No. |
|---|---|---|
| | TCTACAAGGTGCGGGAGATCAACAACTACCACCACGCCCACGACGCCTACCT-<br>GAACGCCGTGGTGGGCACCGCCCTGATCAAGAAGTACCCCAA<br>GCTGGAGAGCGAGTTCGTGTACGGCGACTACAAGGTGTACGACGTGCGGAAGATGATCGC-<br>CAAGAGCGAGCAGGAGATCGGCAAGGCCACCGCC<br>AAGTACTTCTTCTACAGCAACATCATGAACTTCTTCAAGACCGAGATCACCCTGGC-<br>CAACGGCGAGATCCGGAAGCGGCCCCTGATCGAGACCA<br>ACGGCGAGACCGGCGAGATCGTGTGGGACAAGGGCCGGGACTTCGCCACCGTGCG-<br>GAAGGTGCTGAGCATGCCCCAGGTGAACATCGTGAAGAA<br>GACCGAGGTGCAGACCGGCGGCTTCAGCAAGGAGAGCATCCTGCCCAAGCG-<br>GAACAGCGACAAGCTGATCGCCCGGAAGAAGGACTGGGACCCC<br>AAGAAGTACGGCGGCTTCGACAGCCCCACCGTGGCCTACAGCGTGCTGGTGGTGGC-<br>CAAGGTGGAGAAGGGCAAGAGCAAGAAGCTGAAGAGCG<br>TGAAGGAGCTGCTGGGCATCACCATCATGGAGCGGAGCAGCTTCGAGAAGAACCC-<br>CATCGACTTCCTGGAGGCCAAGGGCTACAAGGAGGTGAA<br>GAAGGACCTGATCATCAAGCTGCCCAAGTACAGCCTGTTCGAGCTGGAGAACGGCCG-<br>GAAGCGGATGCTGGCCAGCGCCGGCGAGCTGCAGAAG<br>GGCAACGAGCTGGCCCTGCCCAGCAAGTACGTGAACTTCCTGTACCTGGCCAGCCAC-<br>TACGAGAAGCTGAAGGGCAGCCCCGAGGACAACGAGC<br>AGAAGCAGCTGTTCGTGGAGCAGCACAAGCACTACCTGGACGAGATCATCGAGCA-<br>GATCAGCGAGTTCAGCAAGCGGGTGATCCTGGCCGACGC<br>CAACCTGGACAAGGTGCTGAGCGCCTACAACAAGCACCGGGACAAGCCCATCCGG-<br>GAGCAGGCCGAGAACATCATCCACCTGTTCACCCTGACC<br>AACCTGGGCGCCCCCGCCGCCTTCAAGTACTTCGACACCACCATCGACCGGAAGCGGTA-<br>CACCAGCACCAAGGAGGTGCTGGACGCCACCCTGA<br>TCCACCAGAGCATCACCGGCCTGTACGAGACCCGGATCGACCTGAGCCAGCTGGGCGGCGACTGA | |
| dCas9 ORF using low A/U codons of Table 4, with start and stop codons | ATGGACAAGAAGTACAGCATCGGCCTGGcCATCGGCCACCAACAGCGTGGGCTGGGCCGT-<br>GATCACCGACGAGTACAAGGTGCCCAGCAAGAAGT<br>TCAAGGTGCTGGGCAACACCGACCGGCACAGCATCAAGAAGAACCT-<br>GATCGGCGCCCTGCTGTTCGACAGCGGCGAGACCGCCGAGGCCACCCG<br>GCTGAAGCGGACCGCCCGGCGGCGGTACACCCGGCGGAAGAACCGGATCTGC-<br>TACCTGCAGGAGATCTTCAGCAACGAGATGGCCAAGGTGGAC<br>GACAGCTTCTTCCACCGGCTGGAGGAGAGCTTCCTGGTGGAG-<br>GAGGACAAGAAGCACGAGCGGCACCCCATCTTCGGCAACATCGTGGACGAGG<br>TGGCCTACCACGAGAAGTACCCCACCATCTACCACCTGCGC-<br>GAAGAAGCTGGTGGACAGCACCGACAAGGCCGACCTGCGGCTGATCTACCTGGC<br>CCTGGCCCACATGATCAAGTTCCGGGGCCACTTCCTGATCGAGGGCGACCT-<br>GAACCCCGACAACAGCGACGTGGACAAGCTGTTCATCCAGCTG<br>GTGCAGACCTACAACCAGCTGTTCGAGGAGAACCCCATCAACGCCAGCGGCGTGGACGC-<br>CAAGGCCATCCTGAGCGCCCGGCTGAGCAAGAGCC<br>GGCGGCTGGAGAACCT-<br>GATCGCCCAGCTGCCCGGCGAGAAGAAGAACGGCCTGTTCGGCAACCTGATCGCCCTGAGCCTGGGCCTGACCCCCAA<br>CTTCAAGAGCAACTTCGACCTGGCCGAGGACGCCAAGCTGCAGCTGAGCAAGGACACC-<br>TACGACGACGACCTGGACAACCTGCTGGCCCAGATC<br>GGCGACCAGTACGCCGACCTGTTCCTGGCCGCCAAGAACCTGAGCGACGCCATCCTGCT-<br>GAGCGACATCCTGCGGGTGAACACCGAGATCACCA<br>AGGCCCCCCTGAGCGCCAGCATGATCAAGCGGTACGACGAGCAC-<br>CACCAGGACCTGACCCTGCTGAAGGCCCTGGTGCGGCAGCAGCTGCCCGA<br>GAAGTACAAGGAGATCTTCTTCGACCAGAGCAAGAACGGCTACGCCGGCTA-<br>CATCGACGGCGGCGCCAGCCAGGAGGAGTTCTACAAGTTCATC<br>AAGCCCATCCTGGAGAAGATGGACGGCACCGAGGAGCTGCTGGTGAAGCTGAACCGG-<br>GAGGACCTGCTGCGGAAGCAGCGGACCTTCGACAACG<br>GCAGCATCCCCCACCAGATCCACCTGGGCGAGCTGCACGCCATCCTGCGGCGGCAG-<br>GAGGACTTCTACCCCTTCCTGAAGGACAACCGGGAGAA<br>GATCGAGAAGATCCTGACCTTCCGGATCCCCTAC-<br>TACGTGGGCCCCCTGGCCCGGGGCAACAGCCGGTTCGCCTGGATGACCCGGAAGAGCGAG<br>GAGACCATCACCCCCTGGAACTTCGAG-<br>GAGGTGGTGGACAAGGGCGCCAGCGCCCAGAGCTTCATCGAGCGGATGACCAACTTCGACAAGAACC<br>TGCCCAACGAGAAGGTGCTGCCCAAGCACAGCCTGCTGTACGAGTACTTCACCGTGTA-<br>CAACGAGCTGACCAAGGTGAAGTACGTGACCGAGGG<br>CATGCGGAAGCCCGCCTTCCTGAGCGGCGAGCAGAAGAAGGCCATCGTGGACCTGCTGTT-<br>CAAGACCAACCGGAAGGTGACCGTGAAGCAGCTG<br>AAGGAGGACTACTTCAAGAAGATCGAGTGCTTCGACAGCGTGGAGATCAGCGGCGTG-<br>GAGGACCGGTTCAACGCCAGCCTGGGCACCTACCACG<br>ACCTGCTGAAGATCATCAAGGACAAGGACTTCCTGGACAACGAGGAGAACGAGGA-<br>CATCCTGGAGGACATCGTGCTGACCCTGACCCTGTTCGA<br>GGACCGGGAGATGATCGAGGAGCGGCTGAAGACCTACGCCCACCTGTTCGACGACAAGGT-<br>GATGAAGCAGCTGAAGCGGCGGCGGTACACCGGC<br>TGGGGCCGGCTGAGCCGGAAGCTGATCAACGGCATCCGGGACAAGCAGAGCGGCAAGAC-<br>CATCCTGGACTTCCTGAAGAGCGACGCCTTCGCCA<br>ACCGGAACTTCATGCAGCTGATCCACGACGACAGCCTGACCTTCAAGGAGGA-<br>CATCCAGAAGGCCCAGGTGAGCGGCCAGGGCGACAGCCTGCA<br>CGAGCACATCGCCAACCTGGCCGGCAGCCCCGCCATCAAGAAGGGCATCCTGCAGACCGT-<br>GAAGGTGGTGGACGAGCTGGTGAAGGTGATGGGC<br>CGGCACAAGCCCGAGAACATCGTGATCGAGATGGCCCGGGAGAACCAGAC-<br>CACCCAGAAGGGCCAGAAGAACAGCCGGGAGCGGATGAAGCGGA | 125 |

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | TCGAGGAGGGCATCAAGGAGCTGGGCAGCCAGATCCTGAAGGAGCACCCCGTG-<br>GAGAACACCCAGCTGCAGAACGAGAAGCTGTACCTGTACTA<br>CCTGCAGAACGGCCGGGACATGTACGTGGACCAGGAGCTGGACATCAACCGGCT-<br>GAGCGACTACGACGTGGACgcCATCGTGCCCCAGAGCTTC<br>CTGAAGGACGACAGCATCGACAACAAGGTGCTGACCCG-<br>GAGCGACAAGAACCGGGGCAAGAGCGACAACGTGCCCAGCGAGGAGGTGGTGAAGA<br>AGATGAAGAACTACTGGCGGCAGCTGCTGAACGCCAAGCTGATCACCCAGCG-<br>GAAGTTCGACAACCTGACCAAGGCCGAGCGGGGCGGCCTGAG<br>CGAGCTGGACAAGGCCGGCTTCATCAAGCGGCAGCTGGTGGAGACCCGGCAGATCAC-<br>CAAGCACGTGGCCCAGATCCTGGACAGCCGGATGAAC<br>ACCAAGTACGACGAGAACGACAAGCTGATCCGGGAGGTGAAGGTGATCACCCT-<br>GAAGAGCAAGCTGGTGAGCGACTTCCGGAAGGACTTCCAGT<br>TCTACAAGGTGCGGGAGATCAACAACTACCACCACGCCCACGACGCCTACCT-<br>GAACGCCGTGGTGGGCACCGCCCTGATCAAGAAGTACCCCAA<br>GCTGGAGAGCGAGTTCGTGTACGGCGACTACAAGGTGTACGACGTGCGGAAGATGATCGC-<br>CAAGAGCGAGCAGGAGATCGGCAAGGCCACCGCC<br>AAGTACTTCTTCTACAGCAACATCATGAACTTCTTCAAGACCGAGATCACCCTGGC-<br>CAACGGCGAGATCCGGAAGCGGCCCCTGATCGAGACCA<br>ACGGCGAGACCGGCGAGATCGTGTGGGACAAGGGCCGGGACTTCGCCACCGTGCG-<br>GAAGGTGCTGAGCATGCCCCAGGTGAACATCGTGAAGAA<br>GACCGAGGTGCAGACCGGCGGCTTCAGCAAGGAGAGCATCCTGCCCAAGCG-<br>GAACAGCGACAAGCTGATCGCCCGGAAGAAGGACTGGGACCCC<br>AAGAAGTACGGCGGCTTCGACAGCCCCACCGTGGCCTACAGCGTGCTGGTGGTGGC-<br>CAAGGTGGAGAAGGGCAAGAGCAAGAAGCTGAAGAGCG<br>TGAAGGAGCTGCTGGGCATCACCATCATGGAGCGGAGCAGCTTCGAGAAGAACCC-<br>CATCGACTTCCTGGAGGCCAAGGGCTACAAGGAGGTGAA<br>GAAGGACCTGATCATCAAGCTGCCCAAGTACAGCCTGTTCGAGCTGGAGAACGGCCG-<br>GAAGCGGATGCTGGCCAGCGCCGGCGAGCTGCAGAAG<br>GGCAACGAGCTGGCCCTGCCCAGCAAGTACGTGAACTTCCTGTACCTGGCCAGCCAC-<br>TACGAGAAGCTGAAGGGCAGCCCCGAGGACAACGAGC<br>AGAAGCAGCTGTTCGTGGAGCAGCACAAGCACTACCTGGACGAGATCATCGAGCA-<br>GATCAGCGAGTTCAGCAAGCGGGTGATCCTGGCCGACGC<br>CAACCTGGACAAGGTGCTGAGCGCCTACAACAAGCACCGGGACAAGCCCATCCGG-<br>GAGCAGGCCGAGAACATCATCCACCTGTTCACCCTGACC<br>AACCTGGGCGCCCCCGCCGCCTTCAAGTACTTCGACACCACCATCGACCGGAAGCGGTA-<br>CACCAGCACCAAGGAGGTGCTGGACGCCACCCTGA<br>TCCACCAGAGCATCACCGGCCTGTACGAGACCCGGATCGACCT-<br>GAGCCAGCTGGGCGGCGACGGCGGCGGCAGCCCCAAGAAGAAGCGGAAGGT<br>GTGA | |
| dCas9 ORF using low A/U codons of Table 4, with two C-terminal NLS sequences and start | ATGGACAAGAAGTACAGCATCGGCCTGGCCATCGGCACCAACAGCGTGGGCTGGGCCGT-<br>GATCACCGACGAGTACAAGGTGCCCAGCAAGAAGT<br>TCAAGGTGCTGGGCAACACCGACCGGCACAGCATCAAGAAGAACCT-<br>GATCGGCGCCCTGCTGTTCGACAGCGGCGAGACCGCCGAGGCCACCCG<br>GCTGAAGCGGACCGCCCGGCGGCGGTACACCCGGCGGAAGAACCGGATCTGC-<br>TACCTGCAGGAGATCTTCAGCAACGAGATGGCCAAGGTGGAC<br>GACAGCTTCTTCCACCGGCTGGAGGAGAGCTTCCTGGTGGAG-<br>GAGGACAAGAAGCACGAGCGGCACCCCATCTTCGGCAACATCGTGGACGAGG<br>TGGCCTACCACGAGAAGTACCCCACCATCTACCACCTGCG-<br>GAAGAAGCTGGTGGACAGCACCGACAAGGCCGACCTGCGGCTGATCTACCTGGC<br>CCTGGCCCACATGATCAAGTTCCGGGGCCACTTCCTGATCGAGGGCGACCT-<br>GAACCCCGACAACAGCGACGTGGACAAGCTGTTCATCCAGCTG<br>GTGCAGACCTACAACCAGCTGTTCGAGGAGAACCCCATCAACGCCAGCGGCGTGGACGC-<br>CAAGGCCATCCTGAGCGCCCGGCTGAGCAAGAGCC<br>GGCGGCTGGAGAACCT-<br>GATCGCCCAGCTGCCCGGCGAGAAGAAGAACGGCCTGTTCGGCAACCTGATCGCCCTGAGCCTGGGCCTGACCCCCAA<br>CTTCAAGAGCAACTTCGACCTGGCCGAGGACGCCAAGCTGCAGCTGAGCAAGGACACC-<br>TACGACGACGACCTGGACAACCTGCTGGCCCAGATC<br>GGCGACCAGTACGCCGACCTGTTCCTGGCCGCCAAGAACCTGAGCGACGCCATCCTGCT-<br>GAGCGACATCCTGCGGGTGAACACCGAGATCACCA<br>AGGCCCCCCTGAGCGCCAGCATGATCAAGCGGTACGACGAGCAC-<br>CACCAGGACCTGACCCTGCTGAAGGCCCTGGTGCGGCAGCAGCTGCCCGA<br>GAAGTACAAGGAGATCTTCTTCGACCAGAGCAAGAACGGCTACGCCGGCTA-<br>CATCGACGGCGGCGCCAGCCAGGAGGAGTTCTACAAGTTCATC<br>AAGCCCATCCTGGAGAAGATGGACGGCACCGAGGAGCTGCTGGTGAAGCTGAACCGG-<br>GAGGACCTGCTGCGGAAGCAGCGGACCTTCGACAACG<br>GCAGCATCCCCCACCAGATCCACCTGGGCGAGCTGCACGCCATCCTGCGGCGGCAG-<br>GAGGACTTCTACCCCTTCCTGAAGGACAACCGGGAGAA<br>GATCGAGAAGATCCTGACCTTCCGGATCCCCTAC-<br>TACGTGGGCCCCCTGGCCCGGGGCAACAGCCGGTTCGCCTGGATGACCCGGAAGAGCGAG<br>GAGACCATCACCCCCTGGAACTTCGAG-<br>GAGGTGGTGGACAAGGGCGCCAGCGCCCAGAGCTTCATCGAGCGGATGACCAACTTCGACAAGAACC<br>TGCCCAACGAGAAGGTGCTGCCCAAGCACAGCCTGCTGTACGAGTACTTCACCGTGTA-<br>CAACGAGCTGACCAAGGTGAAGTACGTGACCGAGGG<br>CATGCGGAAGCCCGCCTTCCTGAGCGGCGAGCAGAAGAAGGCCATCGTGGACCTGCTGTT-<br>CAAGACCAACCGGAAGGTGACCGTGAAGCAGCTG | 126 |

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| and stop codons | AAGGAGGACTACTTCAAGAAGATCGAGTGCTTCGACAGCGTGGAGATCAGCGGCGTG-GAGGACCGGTTCAACGCCAGCCTGGGCACCTACCACG<br>ACCTGCTGAAGATCATCAAGGACAAGGACTTCCTGGACAACGAGGAGAACGAGGA-CATCCTGGAGGACATCGTGCTGACCCTGACCCTGTTCGA<br>GGACCGGGAGATGATCGAGGAGCGGCTGAAGACCTACGCCCACCTGTTCGACGACAAGGT-GATGAAGCAGCTGAAGCGGCGGCGGTACACCGGC<br>TGGGGCCGGCTGAGCCGGAAGCTGATCAACGGCATCCGGGACAAGCAGAGCGGCAAGAC-CATCCTGGACTTCCTGAAGAGCGACGGCTTCGCCA<br>ACCGGAACTTCATGCAGCTGATCCACGACGACAGCCTGACCTTCAAGGAGGA-CATCCAGAAGGCCCAGGTGAGCGGCCAGGGCGACAGCCTGCA<br>CGAGCACATCGCCAACCTGGCCGGCAGCCCCGCCATCAAGAAGGGCATCCTGCAGACCGT-GAAGGTGGTGGACGAGCTGGTGAAGGTGATGGGC<br>CGGCACAAGCCCGAGAACATCGTGATCGAGATGGCCCGGGAGAACCAGAC-CACCCAGAAGGGCCAGAAGAACAGCCGGGAGCGGATGAAGCGGA<br>TCGAGGAGGGCATCAAGGAGCTGGGCAGCCAGATCCTGAAGGAGCACCCCGTG-GAGAACACCCAGCTGCAGAACGAGAAGCTGTACCTGTACTA<br>CCTGCAGAACGGCCGGGACATGTACGTGGACCAGGAGCTGGACATCAACCGGCT-GAGCGACTACGACGTGGACGCCATCGTGCCCCAGAGCTTC<br>CTGAAGGACGACAGCATCGACAACAAGGTGCTGACCCG-GAGCGACAAGAACCGGGGCAAGAGCGACAACGTGCCCAGCGAGGAGGTGGTGAAGA<br>AGATGAAGAACTACTGGCGGCAGCTGCTGAACGCCAAGCTGATCACCCAGCG-GAAGTTCGACAACCTGACCAAGGCCGAGCGGGGCGGCCTGAG<br>CGAGCTGGACAAGGCCGGCTTCATCAAGCGGCAGCTGGTGGAGACCCGGCAGATCAC-CAAGCACGTGGCCCAGATCCTGGACAGCCGGATGAAC<br>ACCAAGTACGACGAGAACGACAAGCTGATCCGGGAGGTGAAGGTGATCACCCT-GAAGAGCAAGCTGGTGAGCGACTTCCGGAAGGACTTCCAGT<br>TCTACAAGGTGCGGGAGATCAACAACTACCACCACGCCCACGACGCCTACCT-GAACGCCGTGGTGGGCACCGCCCTGATCAAGAAGTACCCCAA<br>GCTGGAGAGCGAGTTCGTGTACGGCGACTACAAGGTGTACGACGTGCGGAAGATGATCGC-CAAGAGCGAGCAGGAGATCGGCAAGGCCACCGCC<br>AAGTACTTCTTCTACAGCAACATCATGAACTTCTTCAAGACCGAGATCACCCTGGC-CAACGGCGAGATCCGGAAGCGGCCCCTGATCGAGACCA<br>ACGGCGAGACCGGCGAGATCGTGTGGGACAAGGGCCGGGACTTCGCCACCGTGCG-GAAGGTGCTGAGCATGCCCCAGGTGAACATCGTGAAGAA<br>GACCGAGGTGCAGACCGGCGGCTTCAGCAAGGAGAGCATCCTGCCCAAGCG-GAACAGCGACAAGCTGATCGCCCGGAAGAAGGACTGGGACCCC<br>AAGAAGTACGGCGGCTTCGACAGCCCCACCGTGGCCTACAGCGTGCTGGTGGTGGC-CAAGGTGGAGAAGGGCAAGAGCAAGAAGCTGAAGAGCG<br>TGAAGGAGCTGCTGGGCATCACCATCATGGAGCGGAGCAGCTTCGAGAAGAACCC-CATCGACTTCCTGGAGGCCAAGGGCTACAAGGAGGTGAA<br>GAAGGACCTGATCATCAAGCTGCCCAAGTACAGCCTGTTCGAGCTGGAGAACGGCCG-GAAGCGGATGCTGGCCAGCGCCGGCGAGCTGCAGAAG<br>GGCAACGAGCTGGCCCTGCCCAGCAAGTACGTGAACTTCCTGTACCTGGCCAGCCAC-TACGAGAAGCTGAAGGGCAGCCCCGAGGACAACGAGC<br>AGAAGCAGCTGTTCGTGGAGCAGCACAAGCACTACCTGGACGAGATCATCGAGCA-GATCAGCGAGTTCAGCAAGCGGGTGATCCTGGCCGACGC<br>CAACCTGGACAAGGTGCTGAGCGCCTACAACAAGCACCGGGACAAGCCCATCCGG-GAGCAGGCCGAGAACATCATCCACCTGTTCACCCTGACC<br>AACCTGGGCGCCCCCGCCGCCTTCAAGTACTTCGACACCACCATCGACCGGAAGCGGTA-CACCAGCACCAAGGAGGTGCTGGACGCCACCCTGA<br>TCCACCAGAGCATCACCGGCCTGTACGAGACCCGGATCGACCT-GAGCCAGCTGGGCGGCGACGGCAGCGGCAGCCCCAAGAAGAAGCGGAAGGT<br>GGACGGCAGCCCCAAGAAGAAGCGGAAGGTGGACAGCGGCTGA | |
| dCas9 ORF using low A/U codons of Table 4, with start | ATGGACAAGAAGTACAGCATCGGCCTGGCcCATCGGCACCAACAGCGTGGGCTGGGCCGT-GATCACCGACGAGTACAAGGTGCCCAGCAAGAAGT<br>TCAAGGTGCTGGGCAACACCGACCGGCACAGCATCAAGAAGAACCT-GATCGGCGCCCTGCTGTTCGACAGCGGCGAGACCGCCGAGGCCACCCG<br>GCTGAAGCGGACCGCCCGGCGGCGGTACACCCGGCGGAAGAACCGGATCTGC-TACCTGCAGGAGATCTTCAGCAACGAGATGGCCAAGGTGGAC<br>GACAGCTTCTTCCACCGGCTGGAGGAGAGCTTCCTGGTGGAG-GAGGACAAGAAGCACGAGCGGCACCCCATCTTCGGCAACATCGTGGACGAGG<br>TGGCCTACCACGAGAAGTACCCCACCATCTACCACCTGCG-GAAGAAGCTGGTGGACAGCACCGACAAGGCCGACCTGCGGCTGATCTACCTGGC<br>CCTGGCCCACATGATCAAGTTCCGGGGCCACTTCCTGATCGAGGGCGACCT-GAACCCCGACAACAGCGACGTGGACAAGCTGTTCATCCAGCTG<br>GTGCAGACCTACAACCAGCTGTTCGAGGAGAACCCCATCAACGCCAGCGGCGTGGACGC-CAAGGCCATCCTGAGCGCCCGGCTGAGCAAGAGCC<br>GGCGGCTGGAGAACCT-GATCGCCCAGCTGCCCGGCGAGAAGAAGAACGGCCTGTTCGGCAACCTGATCGCCCTGAGCCTGGGCCTGACCCCCAA<br>CTTCAAGAGCAACTTCGACCTGGCCGAGGACGCCAAGCTGCAGCTGAGCAAGGACACC-TACGACGACCTGGACAACCTGCTGGCCCAGATC<br>GGCGACCAGTACGCCGACCTGTTCCTGGCCGCCAAGAACCTGAGCGACGCCATCCTGCT-GAGCGACATCCTGCGGGTGAACACCGAGATCACCA<br>AGGCCCCCCTGAGCGCCAGCATGATCAAGCGGTACGACGAGCAC-CACCAGGACCTGACCCTGCTGAAGGCCCTGGTGCGGCAGCAGCTGCCCGA | 127 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| and stop codons and no NLS | GAAGTACAAGGAGATCTTCTTCGACCAGAGCAAGAACGGCTACGCCGGCTA-CATCGACGGCGGCGCCAGCCAGGAGGAGTTCTACAAGTTCATC AAGCCCATCCTGGAGAAGATGGACGGCACCGAGGAGCTGCTGGTGAAGCTGAACCGG-GAGGACCTGCTGCGGAAGCAGCGGACCTTCGACAACG GCAGCATCCCCCACCAGATCCACCTGGGCGAGCTGCACGCCATCCTGCGGCGGCAG-GAGGACTTCTACCCCTTCCTGAAGGACAACCGGGAGAA GATCGAGAAGATCCTGACCTTCCGGATCCCCTAC-TACGTGGGCCCCCTGGCCCGGGGCAACAGCCGGTTCGCCTGGATGACCCGGAAGAGCGAG GAGACCATCACCCCCTGGAACTTCGAG-GAGGTGGTGGACAAGGGCGCCAGCGCCCAGAGCTTCATCGAGCGGATGACCAACTTCGACAAGAACC TGCCCAACGAGAAGGTGCTGCCCAAGCACAGCCTGCTGTACGAGTACTTCACCGTGTA-CAACGAGCTGACCAAGGTGAAGTACGTGACCGAGGG CATGCGGAAGCCCGCCTTCCTGAGCGGCGAGCAGAAGAAGGCCATCGTGGACCTGCTGTT-CAAGACCAACCGGAAGGTGACCGTGAAGCAGCTG AAGGAGGACTACTTCAAGAAGATCGAGTGCTTCGACAGCGTGGAGATCAGCGGCGTG-GAGGACCGGTTCAACGCCAGCCTGGGCACCTACCACG ACCTGCTGAAGATCATCAAGGACAAGGACTTCCTGGACAACGAGGAGAACGAGGA-CATCCTGGAGGACATCGTGCTGACCCTGACCCTGTTCGA GGACCGGGAGATGATCGAGGAGCGGCTGAAGACCTACGCCCACCTGTTCGACGACAAGGT-GATGAAGCAGCTGAAGCGGCGGCGGTACACCGGC TGGGGCCGGCTGAGCCGGAAGCTGATCAACGGCATCCGGGACAAGCAGAGCGGCAAGAC-CATCCTGGACTTCCTGAAGAGCGACGGCTTCGCCA ACCGGAACTTCATGCAGCTGATCCACGACGACAGCCTGACCTTCAAGGAGGA-CATCCAGAAGGCCCAGGTGAGCGGCCAGGGCGACAGCCTGCA CGAGCACATCGCCAACCTGGCCGGCAGCCCCGCCATCAAGAAGGGCATCCTGCAGACCGT-GAAGGTGGTGGACGAGCTGGTGAAGGTGATGGGC CGGCACAAGCCCGAGAACATCGTGATCGAGATGGCCCGGGAGAACCAGAC-CACCCAGAAGGGCCAGAAGAACAGCCGGGAGCGGATGAAGCGGA TCGAGGAGGGCATCAAGGAGCTGGGCAGCCAGATCCTGAAGGAGCACCCCGTG-GAGAACACCCAGCTGCAGAACGAGAAGCTGTACCTGTACTA CCTGCAGAACGGCCGGGACATGTACGTGGACCAGGAGCTGGACATCAACCGGCT-GAGCGACTACGACGTGGACgcCATCGTGCCCCAGAGCTTC CTGAAGGACGACAGCATCGACAACAAGGTGCTGACCCG-GAGCGACAAGAACCGGGGCAAGAGCGACAACGTGCCCAGCGAGGAGGTGGTGAAGA AGATGAAGAACTACTGGCGGCAGCTGCTGAACGCCAAGCTGATCACCCAGCG-GAAGTTCGACAACCTGACCAAGGCCGAGCGGGGCGGCCTGAG CGAGCTGGACAAGGCCGGCTTCATCAAGCGGCAGCTGGTGGAGACCCGGCAGATCAC-CAAGCACGTGGCCCAGATCCTGGACAGCCGGATGAAC ACCAAGTACGACGAGAACGACAAGCTGATCCGGGAGGTGAAGGTGATCACCCT-GAAGAGCAAGCTGGTGAGCGACTTCCGGAAGGACTTCCAGT TCTACAAGGTGCGGGAGATCAACAACTACCACCACGCCCACGACGCCCTACCT-GAACGCCGTGGTGGGCACCGCCCTGATCAAGAAGTACCCCAA GCTGGAGAGCGAGTTCGTGTACGGCGACTACAAGGTGTACGACGTGCGGAAGATGATCGC-CAAGAGCGAGCAGGAGATCGGCAAGGCCACCGCC AAGTACTTCTTCTACAGCAACATCATGAACTTCTTCAAGACCGAGATCACCCTGGC-CAACGGCGAGATCCGGAAGCGGCCCCTGATCGAGACCA ACGGCGAGACCGGCGAGATCGTGTGGGACAAGGGCCGGGACTTCGCCACCGTGCG-GAAGGTGCTGAGCATGCCCCAGGTGAACATCGTGAAGAA GACCGAGGTGCAGACCGGCGGCTTCAGCAAGGAGAGCATCCTGCCCAAGCG-GAACAGCGACAAGCTGATCGCCCGGAAGAAGGACTGGGACCCC AAGAAGTACGGCGGCTTCGACAGCCCCACCGTGGCCTACAGCGTGCTGGTGGTGGC-CAAGGTGGAGAAGGGCAAGAGCAAGAAGCTGAAGAGCG TGAAGGAGCTGCTGGGCATCACCATCATGGAGCGGAGCAGCTTCGAGAAGAACCC-CATCGACTTCCTGGAGGCCAAGGGCTACAAGGAGGTGAA GAAGGACCTGATCATCAAGCTGCCCAAGTACAGCCTGTTCGAGCTGGAGAACGGCCG-GAAGCGGATGCTGGCCAGCGCCGGCGAGCTGCAGAAG GGCAACGAGCTGGCCCTGCCCAGCAAGTACGTGAACTTCCTGTACCTGGCCAGCCAC-TACGAGAAGCTGAAGGGCAGCCCCGAGGACAACGAGC AGAAGCAGCTGTTCGTGGAGCAGCACAAGCACTACCTGGACGAGATCATCGAGCA-GATCAGCGAGTTCAGCAAGCGGGTGATCCTGGCCGACGC CAACCTGGACAAGGTGCTGAGCGCCTACAACAAGCACCGGGACAAGCCCATCCGG-GAGCAGGCCGAGAACATCATCCACCTGTTCACCCTGACC AACCTGGGCGCCCCCGCCGCCTTCAAGTACTTCGACACCACCATCGACCGGAAGCGGTA-CACCAGCACCAAGGAGGTGCTGGACGCCACCCTGA TCCACCAGAGCATCACCGGCCTGTACGAGACCCGGATCGACCTGAGCCAGCTGGGCGGCGACTGA | |
| Nme Cas9 ORF using low A | ATGGCCGCCTTCAAGCCCAACTCCATCAACTACATCCTGGGCCTGGACATCGG-CATCGCCTCCGTGGGCTGGGCCATGGTGGAGATCGACGAGG AGGAGAACCCCATCCGGCT-GATCGACCTGGGCGTGCGGGTGTTCGAGCGGGCCGAGGTGCCCAAGACCGGCGACTCCCTGGCCATGGCCCGGCG GCTGGCCCGGTCCGTGCGGCGGCTGACCCGGCGGCGGGCC-CACCGGCTGCTGCGGACCCGGCGGCTGCTGAAGCGGGAGGGCGTGCTGCAGGCC GCCAACTTCGACGAGAACGGCCTGATCAAGTCCCTGCC-CAACACCCCCTGGCAGCTGCGGGCCGCCGCCCTGGACCGGAAGCTGACCCCCCTGG AGTGGTCCGCCGTGCTGCTGCACCTGATCAAGCACCGGGGCTACCTGTCCCAGCG-GAAGAACGAGGGCGAGACCGCCGACAAGGAGCTGGGCGC | 128 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| codons of Table 4, with start and stop codons | CCTGCTGAAGGGCGTGGCCGGCAACGCCCACGCCCTGCA-<br>GACCGGCGACTTCCGGACCCCCGCCGAGCTGGCCCTGAACAAGTTCGAGAAGGAG<br>TCCGGCCACATCCGGAACCAGCGGTCCGACTACTCCCACACCTTCTCCCG-<br>GAAGGACCTGCAGGCCGAGCTGATCCTGCTGTTCGAGAAGCAGA<br>AGGAGTTCGGCAACCCCCACGTGTCCGGCGGCCTGAAGGAGGGCATCGAGACCCTGCT-<br>GATGACCCAGCGGCCCGCCCTGTCCGGCGACGCCGT<br>GCAGAAGATGCTGGGCCACTGCACCTTCGAGCCCGCCGAGCCCAAGGCCGC-<br>CAAGAACACCTACACCGCCGAGCGGTTCATCTGGCTGACCAAG<br>CTGAACAACCTGCGGATCCTG-<br>GAGCAGGGCTCCGAGCGGCCCCTGACCGACACCGAGCGGGCCACCCTGATGGACGAGCCCTACCGGAAGTCCA<br>AGCTGACCTACGCCCAGGCCCGGAAGCTGCTGGGCCTGGAGGACACCGCCTTCTT-<br>CAAGGGCCTGCGGTACGGCAAGGACAACGCCGAGGCCTC<br>CACCCTGATGGAGATGAAGGCCTACCACGCCATCTCCCGGGCCCTGGAGAAGGAGGGCCT-<br>GAAGGACAAGAAGTCCCCCCTGAACCTGTCCCCC<br>GAGCTGCAGGACGAGATCGGCACCGCCTTCTCCCTGTTCAAGACCGACGAGGACAT-<br>CACCGGCCGGCTGAAGGACCGGATCCAGCCCGAGATCC<br>TGGAGGCCCTGCTGAAGCACATCTCCTTCGACAAGTTCGTGCAGATCTCCCT-<br>GAAGGCCCTGCGGCGGATCGTGCCCCTGATGGAGCAGGGCAA<br>GCGGTACGACGAGGCCTGCGCCGAGATCTACGGCGACCAC-<br>TACGGCAAGAAGAACACCGAGGAGAAGATCTACCTGCCCCCCATCCCCGCCGAC<br>GAGATCCGGAACCCCGTGGTGCTGCGGGCCCTGTCCCAGGCCCGGAAGGTGAT-<br>CAACGGCGTGGTGCGGCGGTACGGCTCCCCCGCCCGGATCC<br>ACATCGAGACCGCCCGGGAGGTGGGCAAGTCCTTCAAGGACCG-<br>GAAGGAGATCGAGAAGCGGCAGGAGGAGAACCGGAAGGACCGGGAGAAGGC<br>CGCCGCCAAGTTCCGGGAGTACTTCCCCAACTTCGTGGGCGAGCCCAAGTCCAAGGA-<br>CATCCTGAAGCTGCGGCTGTACGAGCAGCAGCACGGC<br>AAGTGCCTGTACTCCGGCAAGGAGATCAACCTGGGCCGGCTGAACGAGAAGGGCTACGTG-<br>GAGATCGACCACGCCCTGCCCTTCTCCCGGACCT<br>GGGACGACTCCTT-<br>CAACAACAAGGTGCTGGTGCTGGGCTCCGAGAACCAGAACAAGGGCAACCAGACCCCCTACGAGTACTTCAACGGCAAGGA<br>CAACTCCCGGGAGTGGCAGGAGTTCAAGGCCCGGGTGGAGACCTCCCGGTTCCCCCGGTC-<br>CAAGAAGCAGCGGATCCTGCTGCAGAAGTTCGAC<br>GAGGACGGCTTCAAGGAGCGGAACCTGAACGACACCCGGTACGT-<br>GAACCGGTTCCTGTGCCAGTTCGTGGCCGACCGGATGCGGCTGACCGGCA<br>AGGGCAAGAAGCGGGTGTTCGCCTCCAACGGCCAGATCAC-<br>CAACCTGCTGCGGGGCTTCTGGGGCCTGCGGAAGGTGCGGGCCGAGAACGACCG<br>GCACCACGCCCTGGACGCCGTGGTGGTGGCCTGCTCCACCGTGGCCATGCAGCAGAAGAT-<br>CACCCGGTTCGTGCGGTACAAGGAGATGAACGCC<br>TTCGACGGCAAGACCATCGACAAGGAGACCGGCGAGGTGCTGCACCAGAAGACC-<br>CACTTCCCCCAGCCCTGGGAGTTCTTCGCCCAGGAGGTGA<br>TGATCCGGGTGTTCGGCAAGCCCGACGGCAAGCCCGAGTTCGAGGAGGCCGACACCCTG-<br>GAGAAGCTGCGGACCCTGCTGGCCGAGAAGCTGTC<br>CTCCCGGCCCGAGGCCGTGCACGAGTACGTGACCCCCCTGTTCGTGTCCCGGGCCCC-<br>CAACCGGAAGATGTCCGGCCAGGGCCACATGGAGACC<br>GTGAAGTCCGC-<br>CAAGCGGCTGGACGAGGGCGTGTCCGTGCTGCGGGTGCCCCTGACCCAGCTGAAGCTGAAGGACCTGGAGAAGATGGTGAACC<br>GGGAGCGGGAGCCCAAGCTGTACGAGGCCCTGAAGGCCCGGCTGGAGGCC-<br>CACAAGGACGACCCCGCCAAGGCCTTCGCCGAGCCCTTCTACAA<br>GTACGACAAGGCCGGCAACCGGACCCAGCAGGTGAAGGCCGTGCGGGTG-<br>GAGCAGGTGCAGAAGACCGGCGTGTGGGTGCGGAACCACAACGGC<br>ATCGCCGACAACGCCACCATGGTGCGGGTGGACGTGTTCGAGAAGGGCGACAAGTAC-<br>TACCTGGTGCCCATCTACTCCTGGCAGGTGGCCAAGG<br>GCATCCTGCCCGACCGGGCCGTGGTGCAGGGCAAGGACGAGGAGGACTGGCAGCT-<br>GATCGACGACTCCTTCAACTTCAAGTTCTCCCTGCACCC<br>CAACGACCTGGTGGAGGTGATCACCAAGAAGGCCCGGATGTTCGGC-<br>TACTTCGCCTCCTGCCACCGGGGCACCGGCAACATCAACATCCGGATC<br>CACGACCTGGACCACAAGATCGGCAAGAACGGCATCCTGGAGGGCATCGGCGTGAA-<br>GACCGCCCTGTCCTTCCAGAAGTACCAGATCGACGAGC<br>TGGGCAAGGAGATCCGGCCCTGCCGGCT-<br>GAAGAAGCGGCCCCCCGTGCGGTCCGGCAAGCGGACCGCCGACGGCTCCGAGTTCGAGTCCCCCAA<br>GAAGAAGCGGAAGGTGGAGTGA | |
| Nme Cas9 ORF using low A/U codons | ATGGCCGCCTTCAAGCCCAACAGCATCAACTACATCCTGGGCCTGGACATCGG-<br>CATCGCCAGCGTGGGCTGGGCCATGGTGGAGATCGACGAGG<br>AGGAGAACCCCATCCGGCT-<br>GATCGACCTGGGCGTGCGGGTGTTCGAGCGGGCCGAGGTGCCCAAGACCGGCGACAGCCTGGCCATGGCCCGGCG<br>GCTGGCCCGGAGCGTGCGGCGGCTGACCCGGCGGCGGGCC-<br>CACCGGCTGCTGCGGACCCGGCGGCTGCTGAAGCGGGAGGGCGTGCTGCAGGCC<br>GCCAACTTCGACGAGAACGCCTGATCAAGAGCCTGCC-<br>CAACACCCCCTGGCAGCTGCGGGCCGCCGCCCTGGACCGGAAGCTGACCCCCCTGG<br>AGTGGAGCGCCGTGCTGCTGCACCTGATCAAGCACCGGGGCTACCTGAGCCAGCG-<br>GAAGAACGAGGGCGAGACCGCCGACAAGGAGCTGGGCGC<br>CCTGCTGAAGGGCGTGGCCGGCAACGCCCACGCCCTGCA-<br>GACCGGCGACTTCCGGACCCCCGCCGAGCTGGCCCTGAACAAGTTCGAGAAGGAG<br>AGCGGCCACATCCGGAACCAGCGGAGCGACTACAGCCACACCTTCAGCCG-<br>GAAGGACCTGCAGGCCGAGCTGATCCTGCTGTTCGAGAAGCAGA | 129 |

| Description | Sequence | SEQ ID No. |
|---|---|---|
| of Table 4, with start and stop codons | AGGAGTTCGGCAACCCCCACGTGAGCGGCGGCCTGAAGGAGGGCATCGAGACCCTGCT-GATGACCCAGCGGCCCGCCCTGAGCGGCGACGCCGT GCAGAAGATGCTGGGCCACTGCACCTTCGAGCCCGCCGAGCCCAAGGCCGC-CAAGAACACCTACACCGCCGAGCGGTTCATCTGGCTGACCAAG CTGAACAACCTGCGGATCCTG-GAGCAGGGCAGCGAGCGGCCCCTGACCGACACCGAGCGGGCCACCCTGATGGACGAGCCCTACCGGAAGAGCA AGCTGACCTACGCCCAGGCCCGGAAGCTGCTGGGCCTGGAGGACACCGCCTTCTT-CAAGGGCCTGCGGTACGGCAAGGACAACGCCGAGGCCAG CACCCTGATGGAGATGAAGGCCTACCACGCCATCAGCCGGGCCCTGGAGAAGGAGGGCCT-GAAGGACAAGAAGAGCCCCCTGAACCTGAGCCCC GAGCTGCAGGACGAGATCGGCACCGCCTTCAGCCTGTTCAAGACCGACGAGGACAT-CACCGGCCGGCTGAAGGACCGGATCCAGCCCGAGATCC TGGAGGCCCTGCTGAAGCACATCAGCTTCGACAAGTTCGTGCAGATCAGCCT-GAAGGCCCTGCGGCGGATCGTGCCCCTGATGGAGCAGGGCAA GCGGTACGACGAGGCCTGCGCCGAGATCTACGGCGACCAC-TACGGCAAGAAGAACACCGAGGAGAAGATCTACCTGCCCCCCATCCCCGCCGAC GAGATCCGGAACCCCGTGGTGCTGCGGGCCCTGAGCCAGGCCCGGAAGGTGAT-CAACGGCGTGGTGCGGCGGTACGGCAGCCCCGCCCGGATCC ACATCGAGACCGCCCGGGAGGTGGGCAAGAGCTTCAAGGACCG-GAAGGAGATCGAGAAGCGGCAGGAGGAGAACCGGAAGGACCGGGAGAAGGC CGCCGCCAAGTTCCGGGAGTACTTCCCCAACTTCGTGGGCGAGCCCAAGAGCAAGGA-CATCCTGAAGCTGCGGCTGTACGAGCAGCAGCACGGC AAGTGCCTGTACAGCGGCAAGGAGATCAACCTGGGCCGGCTGAACGAGAAGGGCTACGTG-GAGATCGACCACGCCCTGCCCTTCAGCCGGACCT GGGACGACAGCTT-CAACAACAAGGTGCTGGTGCTGGGCAGCGAGAACCAGAACAAGGGCAACCAGACCCCCTACGAGTACTTCAACGGCAAGGA CAACAGCCGGGAGTGGCAGGAGTTCAAGGCCCGGGTGGAGACCAGCCGGTTCCCCCG-GAGCAAGAAGCAGCGGATCCTGCTGCAGAAGTTCGAC GAGGACGGCTTCAAGGAGCGGAACCTGAACGACACCCGGTACGT-GAACCGGTTCCTGTGCCAGTTCGTGGCCGACCGGATGCGGCTGACCGGCA AGGGCAAGAAGCGGGTGTTCGCCAGCAACGGCCAGATCAC-CAACCTGCTGCGGGGCTTCTGGGGCCTGCGGAAGGTGCGGGCCGAGAACGACCG GCACCACGCCCTGGACGCCGTGGTGGTGGCCTGCAGCACCGTGGCCATGCAGCAGAAGAT-CACCCGGTTCGTGCGGTACAAGGAGATGAACGCC TTCGACGGCAAGACCATCGACAAGGAGACCGGCGAGGTGCTGCACCAGAAGACC-CACTTCCCCCAGCCCTGGGAGTTCTTCGCCCAGGAGGTGA TGATCCGGGTGTTCGGCAAGCCCGACGGCAAGCCCGAGTTCGAGGAGGCCGACACCCTG-GAGAAGCTGCGGACCCTGCTGGCCGAGAAGCTGAG CAGCCGGCCCGAGGCCGTGCACGAGTACGTGACCCCCCTGTTCGTGAGCCGGGCCCC-CAACCGGAAGATGAGCGGCCAGGGCCACATGGAGACC GTGAAGAGCGCCAAGCGGCTGGACGAGGGCGT-GAGCGTGCTGCGGGTGCCCCTGACCCAGCTGAAGCTGAAGGACCTGGAGAAGATGGTGAACC GGGAGCGGGAGCCCAAGCTGTACGAGGCCCTGAAGGCCCGGCTGGAGGCC-CACAAGGACGACCCCGCCAAGGCCTTCGCCGAGCCCTTCTACAA GTACGACAAGGCCGGCAACCGGACCCAGCAGGTGAAGGCCGTGCGGGTG-GAGCAGGTGCAGAAGACCGGCGTGTGGGTGCGGAACCACAACGGC ATCGCCGACAACGCCACCATGGTGCGGGTGGACGTGTTCGAGAAGGGCGACAAGTAC-TACCTGGTGCCCATCTACAGCTGGCAGGTGGCCAAGG GCATCCTGCCCGACCGGGCCGTGGTGCAGGGCAAGGACGAGGAGGACTGGCAGCT-GATCGACGACAGCTTCAACTTCAAGTTCAGCCTGCACCC CAACGACCTGGTGGAGGTGATCACCAAGAAGGCCCGGATGTTCGGC-TACTTCGCCAGCTGCCACCGGGGCACCGGCAACATCAACATCCGGATC CACGACCTGGACCACAAGATCGGCAAGAACGGCATCCTGGAGGGCATCGGCGTGAA-GACCGCCCTGAGCTTCCAGAAGTACCAGATCGACGAGC TGGGCAAGGAGATCCGGCCCTGCCGGCTGAAGAAGCGGCCCCCCGTGCG-GAGCGGCAAGCGGACCGCCGACGGCAGCGAGTTCGAGAGCCCCAA GAAGAAGCGGAAGGTGGAGTGA | |
| Open reading frame for Cas9 with NLS1, with start | ATGGACAAGAAGTACAGCATCGGACTGGACATCGGAACAAACAGCGTCGGATGGGCAGT-CATCACAGACGAATACAAGGTCCCGAGCAAGAAGT TCAAGGTCCTGGGAAACACAGACAGACAGCATCAAGAAGAACCTGATCG-GAGCACTGCTGTTCGACAGCGGAGAAACAGCAGAAGCAACAAG ACTGAAGAGAACAGCAAGAAGAAGATACAAGAAGAAAGAACAGAATCTGC-TACCTGCAGGAAATCTTCAGCAACGAAATGGCAAAGGTCGAC GACAGCTTCTTCCACAGACTGGAAGAAAGCTTCCTGGTCGAAGAA-GACAAGAAGCACGAAAGACACCCGATCTTCGGAAACATCGTCGACGAAG TCGCATACCACGAAAAGTACCCGACAATCTACCACCT-GAGAAAGAAGCTGGTCGACAGCACAGACAAGGCAGACCTGAGACTGATCTACCTGGC ACTGGCACACATGATCAAGTTCAGAGGACACTTCCTGATCGAAGGAGACCT-GAACCCGGACAACAGCGACGTCGACAAGCTGTTCATCCAGCTG GTCCAGACATACAACCAGCTGTTCGAAGAAAACCCGATCAACGCAAGCG-GAGTCGACGCAAAGGCAATCCTGAGCGCAAGACTGAGCAAGAGCA GAAGACTGGAAAACCTGATCGCACAGCTGCCGGGAGAAAAGAAGAACGGACTGTTCG-GAAACCTGATCGCACTGAGCCTGGGACTGACACCGAA CTTCAAGAGCAACTTCGACCTGGCAGAAGACGCAAAGCTGCAGCTGAGCAAGGACACAT-ACGACGACGACCTGGACAACCTGCTGGCACAGATC | 130 |

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| and stop codons | GGAGACCAGTACGCAGACCTGTTCCTGGCAGCAAAGAACCTGAGCGACGCAATCCTGCT-GAGCGACATCCTGAGAGTCAACACAGAAATCACAA<br>AGGCACCGCTGAGCGCAAGCATGATCAAGAGATACGACGAACAC-CACCAGGACCTGACACTGCTGAAGGCACTGGTCAGACAGCAGCTGCCGGA<br>AAAGTACAAGGAAATCTTCTTCGACCAGAGCAAGAACGGATACGCAGGATACATCGACG-GAGGAGCAAGCCAGGAAGAATTCTACAAGTTCATC<br>AAGCCGATCCTGGAAAAGATGGACGGAACAGAAGAACTGCTGGTCAAGCTGAACAGAGAA-GACCTGCTGAGAAAGCAGAGAACATTCGACAACG<br>GAAGCATCCCGCACCAGATCCACCTGGGAGAACTGCACGCAATCCTGAGAAGACAGGAA-GACTTCTACCCGTTCCTGAAGGACAACAGAGAAAA<br>GATCGAAAAGATCCTGACATTCAGAATCCCGTACTACGTCGGACCGCTGGCAAGAG-GAAACAGCAGATTCGCATGGATGACAAGAAAGAGCGAA<br>GAAACAATCACACCGTGGAACTTCGAAGAAGTCGTCGACAAGG-GAGCAAGCGCACAGAGCTTCATCGAAAGAATGACAAACTTCGACAAGAACC<br>TGCCGAACGAAAAGGTCCTGCCGAAGCACAGCCTGCTGTACGAATACTTCACAGTCTA-CAACGAACTGACAAAGGTCAAGTACGTCACAGAAGG<br>AATGAGAAAGCCGGCATTCCTGAGCGGAGAACAGAAGAAGGCAATCGTCGACCTGCTGTT-CAAGACAAACAGAAAGGTCACAGTCAAGCAGCTG<br>AAGGAAGACTACTTCAAGAAGATCGAATGCTTCGACAGCGTCGAAATCAGCGGAGTCGAA-GACAGATTCAACGCAAGCCTGGGAACATACCACG<br>ACCTGCTGAAGATCATCAAGGACAAGGACTTCCTGGACAACGAAGAAAACGAAGA-CATCCTGGAAGACATCGTCCTGACACTGACACTGTTCGA<br>AGACAGAGAAATGATCGAAGAAAGACTGAAGACATACGCACACCTGTTCGACGACAAGGT-CATGAAGCAGCTGAAGAGAAGAAGATACACAGGA<br>TGGGGAAGACTGAGCAGAAAGCTGATCAACGGAATCAGAGACAAGCAGAGCGGAAA-GACAATCCTGGACTTCCTGAAGAGCGACGGATTCGCAA<br>ACAGAAACTTCATGCAGCTGATCCACGACGACAGCCTGACATTCAAGGAAGA-CATCCAGAAGGCACAGGTCAGCGGACAGGGAGACAGCCTGCA<br>CGAACACATCGCAAACCTGGCAGGAAGCCCGGCAATCAAGAAGGGAATCCTGCAGACAGT-CAAGGTCGTCGACGAACTGGTCAAGGTCATGGGA<br>AGACACAAGCCGGAAAACATCGTCATCGAAATGGCAAGAGAAAACCA-GACAACACAGAAGGGACAGAAGAACAGCAGAGAAAGAATGAAGAGAA<br>TCGAAGAAGGAATCAAGGAACTGGGAAGCCAGATCCT-GAAGGAACACCCGGTCGAAAACACACAGCTGCAGAACGAAAAGCTGTACCTGTACTA<br>CCTGCAGAACGGAAGAGACATGTACGTCGACCAGGAACTGGACATCAACAGACT-GAGCGACTACGACGTCGACCACATCGTCCCGCAGAGCTTC<br>CTGAAGGACGACAGCATCGACAACAAGGTCCTGACAAGAAGCGACAAGAACAGAG-GAAAGAGCGACAACGTCCCGAGCGAAGAAGTCGTCAAGA<br>AGATGAAGAACTACTGGAGACAGCTGCTGAACGCAAAGCTGAT-CACACAGAGAAAGTTCGACAACCTGACAAAGGCAGAGAGAGGAGGACTGAG<br>CGAACTGGACAAGGCAGGATTCATCAAGAGACAGCTGGTCGAAACAAGACAGAT-CACAAAGCACGTCGCACAGATCCTGGACAGCAGAATGAAC<br>ACAAAGTACGACGAAAACGACAAGCTGATCAGAGAAGTCAAGGTCATCACACT-GAAGAGCAAGCTGGTCAGCGACTTCAGAAAGGACTTCCAGT<br>TCTACAAGGTCAGAGAAATCAACAACTACCACCACGCACACGACGCATACCT-GAACGCAGTCGTCGGAACAGCACTGATCAAGAAGTACCCGAA<br>GCTGGAAAGCGAATTCGTCTACGGAGACTACAAGGTCTACGACGTCAGAAAGAT-GATCGCAAAGAGCGAACAGGAAATCGGAAAGGCAACAGCA<br>AAGTACTTCTTCTACAGCAACATCATGAACTTCTTCAAGACAGAAAT-CACACTGGCAAACGGAGAAATCAGAAAGAGACCGCTGATCGAAACAA<br>ACGGAGAAACAGGAGAAATCGTCTGGGACAAGGGAAGA-GACTTCGCAACAGTCAGAAAGGTCCTGAGCATGCCGCAGGTCAACATCGTCAAGAA<br>GACAGAAGTCCAGACAGGAGGAT-TCAGCAAGGAAAGCATCCTGCCGAAGAGAAACAGCGACAAGCTGATCGCAAGAAAGAAGGACTGGGACCCG<br>AAGAAGTACGGAGGATTCGACAGCCCGACAGTCGCATA-CAGCGTCCTGGTCGTCGCAAAGGTCGAAAAGGGAAAGAGCAAGAAGCTGAAGAGCG<br>TCAAGGAACTGCTGGGAATCACAATCATGGAAAGAAGCAGCTTCGAAAAGAACCC-GATCGACTTCCTGGAAGCAAAGGGATACAAGGAAGTCAA<br>GAAGGACCTGATCATCAAGCTGCCGAAGTACAGCCTGTTCGAACTGGAAAACG-GAAGAAAGAGAATGCTGGCAAGCGCAGGAGAACTGCAGAAG<br>GGAAACGAACTGGCACTGCCGAGCAAGTACGTCAACTTCCTGTACCTGGCAAGCCAC-TACGAAAAGCTGAAGGGAAGCCCGGAAGACAACGAAC<br>AGAAGCAGCTGTTCGTCGAACAGCACAAGCACTACCTGGACGAAATCATCGAACA-GATCAGCGAATTCAGCAAGAGAGTCATCCTGGCAGACGC<br>AAACCTGGACAAGGTCCTGAGCGCATACAACAAGCACAGAGACAAGCC-GATCAGAGAACAGGCAGAAAACATCATCCACCTGTTCACACTGACA<br>AACCTGGAGCACCGGCAGCATTCAAGTACTTCGACACAACAATCGACGAAAGAGATA-CACAAGCACAAAGGAAGTCCTGGACGCAACACTGA<br>TCCACCAGAGCATCACAGGACTGTACGAAACAAGGAATCGACCTGAGCCAGCTGGGAGGA-GACGGAGGAGGAAGCCTGGCAGCAAAGAGAAGCAG<br>AACAACATAG | |
| Open reading | ATGGACAAGAAGTACAGCATCGGACTGGACATCGGAACAAACAGCGTCGGATGGGCAGT-CATCACAGACGAATACAAGGTCCCGAGCAAGAAGT<br>TCAAGGTCCTGGGAAACACAGACAGACACAGCATCAAGAAGAACCTGATCG-GAGCACTGCTGTTCGACAGCGGAGAAACAGCAGAAGCAACAAG | 131 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| frame for Cas9 with NLS2, with start and stop codons | ACTGAAGAGAACAGCAAGAAGAAGATACACAAGAAGAAAGAACAGAATCTGC-TACCTGCAGGAAATCTTCAGCAACGAAATGGCAAAGGTCGAC<br>GACAGCTTCTTCCACAGACTGGAAGAAAGCTTCCTGGTCGAAGAA-GACAAGAAGCACGAAAGACACCCGATCTTCGGAAACATCGTCGACGAAG<br>TCGCATACCACGAAAAGTACCCGACAATCTACCACCT-GAGAAAGAAGCTGGTCGACAGCACAGACAAGGCAGACCTGAGACTGATCTACCTGGC<br>ACTGGCACACATGATCAAGTTCAGAGGACACTTCCTGATCGAAGGAGACCT-GAACCCGGACAACAGCGACGTCGACAAGCTGTTCATCCAGCTG<br>GTCCAGACATACAACCAGCTGTTCGAAGAAAACCCGATCAACGCAAGCG-GAGTCGACGCAAAGGCAATCCTGAGCGCAAGACTGAGCAAGAGCA<br>GAAGACTGGAAAACCTGATCGCACAGCTGCCGGGAGAAAAGAAGAACGGACTGTTCG-GAAACCTGATCGCACTGAGCCTGGGACTGACACCGAA<br>CTTCAAGAGCAACTTCGACCTGGCAGAAGACGCAAAGCTGCAGCTGAGCAAGGACACAT-ACGACGACGACCTGGACAACCTGCTGGCACAGATC<br>GGAGACCAGTACGCAGACCTGTTCCTGGCAGCAAAGAACCTGAGCGACGCAATCCTGCT-GAGCGACATCCTGAGAGTCAACACAGAAATCACAA<br>AGGCACCGCTGAGCGCAAGCATGATCAAGAGATACGACGAACAC-CACCAGGACCTGACACTGCTGAAGGCACTGGTCAGACAGCAGCTGCCGGA<br>AAAGTACAAGGAAATCTTCTTCGACCAGAGCAAGAACGGATACGCAGGATACATCGACG-GAGGAGCAAGCCAGGAAGAATTCTACAAGTTCATC<br>AAGCCGATCCTGGAAAAGATGGACGGAACAGAAGAACTGCTGGTCAAGCTGAACAGAGAA-GACCTGCTGAGAAAGCAGAGAACATTCGACAACG<br>GAAGCATCCCGCACCAGATCCACCTGGGAGAACTGCACGCAATCCTGAGAAGACAGGAA-GACTTCTACCCGTTCCTGAAGGACAACAGAGAAAA<br>GATCGAAAAGATCCTGACATTCAGAATCCCGTACTACGTCGGACCGCTGGCAAGAG-GAAACAGCAGATTCGCATGGATGACAAGAAAGAGCGAA<br>GAAACAATCACACCGTGGAACTTCGAAGAAGTCGTCGACAAGG-GAGCAAGCGCACAGAGCTTCATCGAAAGAATGACAAACTTCGACAAGAACC<br>TGCCGAACGAAAAGGTCCTGCCGAAGCACAGCCTGCTGTACGAATACTTCACAGTCTA-CAACGAACTGACAAAGGTCAAGTACGTCACAGAAGG<br>AATGAGAAAGCCGGCATTCCTGAGCGGAGAACAGAAGAAGGCAATCGTCGACCTGCTGTT-CAAGACAAACAGAAAGGTCACAGTCAAGCAGCTG<br>AAGGAAGACTACTTCAAGAAGATCGAATGCTTCGACAGCGTCGAAATCAGCGGAGTCGAA-GACAGATTCAACGCAAGCCTGGGAACATACCACG<br>ACCTGCTGAAGATCATCAAGGACAAGGACTTCCTGGACAACGAAGAAAACGAAGA-CATCCTGGAAGACATCGTCCTGACACTGACACTGTTCGA<br>AGACAGAGAAATGATCGAAGAAAGACTGAAGACATACGCACACCTGTTCGACGACAAGGT-CATGAAGCAGCTGAAGAGAAGAAGATACACAGGA<br>TGGGGAAGACTGAGCAGAAAGCTGATCAACGGAATCAGAGACAAGCAGAGCGGAAA-GACAATCCTGGACTTCCTGAAGAGCGACGGATTCGCAA<br>ACAGAAACTTCATGCAGCTGATCCACGACGACAGCCTGACATTCAAGGAAGA-CATCCAGAAGGCACAGGTCAGCGGACAGGGAGACAGCCTGCA<br>CGAACACATCGCAAACCTGGCAGGAAGCCCGGCAATCAAGAAGGGAATCCTGCAGACAGT-CAAGGTCGTCGACGAACTGGTCAAGGTCATGGGA<br>AGACACAAGCCGGAAAACATCGTCATCGAAATGGCAAGAGAAAACCA-GACAACACAGAAGGGACAGAAGAACAGCAGAGAAAGAATGAAGAGAA<br>TCGAAGAAGGAATCAAGGAACTGGGAAGCCAGATCCT-GAAGGAACACCCGGTCGAAAACACACAGCTGCAGAACGAAAAGCTGTACCTGTACTA<br>CCTGCAGAACGGAAGAGACATGTACGTCGACCAGGAACTGGACATCAACAGACT-GAGCGACTACGACGTCGACCACATCGTCCCGCAGAGCTTC<br>CTGAAGGACGACAGCATCGACAACAAGGTCCTGACAAGAAGCGACAAGAACAGAG-GAAAGAGCGACAACGTCCCGAGCGAAGAAGTCGTCAAGA<br>AGATGAAGAACTACTGGAGACAGCTGCTGAACGCAAAGCTGAT-CACACAGAGAAAGTTCGACAACCTGACAAAGGCAGAGAGAGGAGGACTGAG<br>CGAACTGGACAAGGCAGGATTCATCAAGAGACAGCTGGTCGAAACAAGACAGAT-CACAAAGCACGTCGCACAGATCCTGGACAGCAGAATGAAC<br>ACAAAGTACGACGAAAACGACAAGCTGATCAGAGAAGTCAAGGTCATCACACT-GAAGAGCAAGCTGGTCAGCGACTTCAGAAAGGACTTCCAGT<br>TCTACAAGGTCAGAGAAATCAACAACTACCACCACGCACACGACGCATACCT-GAACGCAGTCGTCGGAACAGCACTGATCAAGAAGTACCCGAA<br>GCTGGAAAGCGAATTCGTCTACGGAGACTACAAGGTCTACGACGTCAGAAAGAT-GATCGCAAAGAGCGAACAGGAAATCGGAAAGGCAACAGCA<br>AAGTACTTCTTCTACAGCAACATCATGAACTTCTTCAAGACAGAAAT-CACACTGGCAAACGGAGAAATCAGAAAGAGACCGCTGATCGAAACAA<br>ACGGAGAAACAGGAGAAATCGTCTGGGACAAGGGAAGA-GACTTCGCAACAGTCAGAAAGGTCCTGAGCATGCCGCAGGTCAACATCGTCAAGAA<br>GACAGAAGTCCAGACAGGAGGAT-TCAGCAAGGAAAGCATCCTGCCGAAGAGAAACAGCGACAAGCTGATCGCAAGAAAGAAGGACTGGGACCCG<br>AAGAAGTACGGAGGATTCGACAGCCCGACAGTCGCATA-CAGCGTCCTGGTCGTCGCAAAGGTCGAAAAGGGAAAGAGCAAGAAGCTGAAGAGCG<br>TCAAGGAACTGCTGGGAATCACAATCATGGAAAGAAGCAGCTTCGAAAAGAACCC-GATCGACTTCCTGGAAGCAAAGGGATACAAGGAAGTCAA<br>GAAGGACCTGATCATCAAGCTGCCGAAGTACAGCCTGTTCGAACTGGAAAACG-GAAGAAAGAGAATGCTGGCAAGCGCAGGAGAACTGCAGAAG<br>GGAAACGAACTGGCACTGCCGAGCAAGTACGTCAACTTCCTGTACCTGGCAAGCCAC-TACGAAAAGCTGAAGGGAAGCCCGGAAGACAACGAAC | |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | AGAAGCAGCTGTTCGTCGAACAGCACAAGCACTACCTGGACGAAATCATCGAACA-<br>GATCAGCGAATTCAGCAAGAGAGTCATCCTGGCAGACGC<br>AAACCTGGACAAGGTCCTGAGCGCATACAACAAGCACAGAGACAAGCC-<br>GATCAGAGAACAGGCAGAAAACATCATCCACCTGTTCACACTGACA<br>AACCTGGGAGCACCGGCAGCATTCAAGTACTTCGACACAACAATCGACAGAAAGAGATA-<br>CACAAGCACAAAGGAAGTCCTGGACGCAACACTGA<br>TCCACCAGAGCATCACAGGACTGTACGAAACAAGAATCGACCTGAGCCAGCTGGGAGGA-<br>GACGGAGGAGGAAGCCAGGCAGCAAAGAGAAGCAG<br>AACAACATAG | |
| Open reading frame for Cas9 with NLS3, with start and stop codons | ATGGACAAGAAGTACAGCATCGGACTGGACATCGGAACAAACAGCGTCGGATGGGCAGT-<br>CATCACAGACGAATACAAGGTCCCGAGCAAGAAGT<br>TCAAGGTCCTGGGAAACACAGACAGACACAGCATCAAGAAGAACCTGATCG-<br>GAGCACTGCTGTTCGACAGCGGAGAAACAGCAGAAGCAACAAG<br>ACTGAAGAGAACAGCAAGAAGAAGATACACAAGAAGAAAGAACAGAATCTGC-<br>TACCTGCAGGAAATCTTCAGCAACGAAATGGCAAAGGTCGAC<br>GACAGCTTCTTCCACAGACTGGAAGAAAGCTTCCTGGTCGAAGAA-<br>GACAAGAAGCACGAAAGACACCCGATCTTCGGAAACATCGTCGACGAAG<br>TCGCATACCACGAAAAGTACCCGACAATCTACCACCT-<br>GAGAAAGAAGCTGGTCGACAGCACAGACAAGGCAGACCTGAGACTGATCTACCTGGC<br>ACTGGCACACATGATCAAGTTCAGAGGACACTTCCTGATCGAAGGAGACCT-<br>GAACCCGGACAACAGCGACGTCGACAAGCTGTTCATCCAGCTG<br>GTCCAGACATACAACCAGCTGTTCGAAGAAAACCCGATCAACGCAAGCG-<br>GAGTCGACGCAAAGGCAATCCTGAGCGCAAGACTGAGCAAGAGCA<br>GAAGACTGGAAAACCTGATCGCACAGCTGCCGGGAGAAAAGAAGAACGGACTGTTCG-<br>GAAACCTGATCGCACTGAGCCTGGGACTGACACCGAA<br>CTTCAAGAGCAACTTCGACCTGGCAGAAGACGCAAAGCTGCAGCTGAGCAAGGACACAT-<br>ACGACGACGACCTGGACAACCTGCTGGCACAGATC<br>GGAGACCAGTACGCAGACCTGTTCCTGGCAGCAAAGAACCTGAGCGACGCAATCCTGCT-<br>GAGCGACATCCTGAGAGTCAACACAGAAATCACAA<br>AGGCACCGCTGAGCGCAAGCATGATCAAGAGATACGACGAACAC-<br>CACCAGGACCTGACACTGCTGAAGGCACTGGTCAGACAGCAGCTGCCGGA<br>AAAGTACAAGGAAATCTTCTTCGACCAGAGCAAGAACGGATACGCAGGATACATCGACG-<br>GAGGAGCAAGCCAGGAAGAATTCTACAAGTTCATC<br>AAGCCGATCCTGGAAAAGATGGACGGAACAGAAGAACTGCTGGTCAAGCTGAACAGAGAA-<br>GACCTGCTGAGAAAGCAGAGAACATTCGACAACG<br>GAAGCATCCCGCACCAGATCCACCTGGGAGAACTGCACGCAATCCTGAGAAGACAGGAA-<br>GACTTCTACCCGTTCCTGAAGGACAACAGAGAAAA<br>GATCGAAAAGATCCTGACATTCAGAATCCCGTACTACGTCGGACCGCTGGCAAGAG-<br>GAAACAGCAGATTCGCATGGATGACAAGAAAGAGCGAA<br>GAAACAATCACACCGTGGAACTTCGAAGAAGTCGTCGACAAGG-<br>GAGCAAGCGCACAGAGCTTCATCGAAAGAATGACAAACTTCGACAAGAACC<br>TGCCGAACGAAAAGGTCCTGCCGAAGCACAGCCTGCTGTACGAATACTTCACAGTCTA-<br>CAACGAACTGACAAAGGTCAAGTACGTCACAGAAGG<br>AATGAGAAAGCCGGCATTCCTGAGCGGAGAACAGAAGAAGGCAATCGTCGACCTGCTGTT-<br>CAAGACAAACAGAAAGGTCACAGTCAAGCAGCTG<br>AAGGAAGACTACTTCAAGAAGATCGAATGCTTCGACAGCGTCGAAATCAGCGGAGTCGAA-<br>GACAGATTCAACGCAAGCCTGGGAACATACCACG<br>ACCTGCTGAAGATCATCAAGGACAAGGACTTCCTGGACAACGAAGAAAACGAAGA-<br>CATCCTGGAAGACATCGTCCTGACACTGACACTGTTCGA<br>AGACAGAGAAATGATCGAAGAAAGACTGAAGACATACGCACACCTGTTCGACGACAAGGT-<br>CATGAAGCAGCTGAAGAGAAGAAGATACACAGGA<br>TGGGGAAGACTGAGCAGAAAGCTGATCAACGGAATCAGAGACAAGCAGAGCGGAAA-<br>GACAATCCTGGACTTCCTGAAGAGCGACGGATTCGCAA<br>ACAGAAACTTCATGCAGCTGATCCACGACGACAGCCTGACATTCAAGGAAGA-<br>CATCCAGAAGGCACAGGTCAGCGGACAGGGAGACAGCCTGCA<br>CGAACACATCGCAAACCTGGCAGGAAGCCCGGCAATCAAGAAGGGAATCCTGCAGACAGT-<br>CAAGGTCGTCGACGAACTGGTCAAGGTCATGGGA<br>AGACACAAGCCGGAAAACATCGTCATCGAAATGGCAAGAGAAAACCA-<br>GACAACACAGAAGGGACAGAAGAACAGCAGAGAAAGAATGAAGAGAA<br>TCGAAGAAGGAATCAAGGAACTGGGAAGCCAGATCCT-<br>GAAGGAACACCCGGTCGAAAACACACAGCTGCAGAACGAAAAGCTGTACCTGTACTA<br>CCTGCAGAACGGAAGAGACATGTACGTCGACCAGGAACTGGACATCAACAGACT-<br>GAGCGACTACGACGTCGACCACATCGTCCCGCAGAGCTTC<br>CTGAAGGACGACAGCATCGACAACAAGGTCCTGACAAGAAGCGACAAGAACAGAG-<br>GAAAGAGCGACAACGTCCCGAGCGAAGAAGTCGTCAAGA<br>AGATGAAGAACTACTGGAGACAGCTGCTGAACGCAAAGCTGAT-<br>CACACAGAGAAAGTTCGACAACCTGACAAAGGCAGAGAGAGGAGGACTGAG<br>CGAACTGGACAAGGCAGGATTCATCAAGAGACAGCTGGTCGAAACAAGACAGAT-<br>CACAAAGCACGTCGCACAGATCCTGGACAGCAGAATGAAC<br>ACAAAGTACGACGAAAACGACAAGCTGATCAGAGAAGTCAAGGTCATCACACT-<br>GAAGAGCAAGCTGGTCAGCGACTTCAGAAAGGACTTCCAGT<br>TCTACAAGGTCAGAGAAATCAACAACTACCACCACGCACACGACGCATACCT-<br>GAACGCAGTCGTCGGAACAGCACTGATCAAGAAGTACCCGAA<br>GCTGGAAAGCGAATTCGTCTACGGAGACTACAAGGTCTACGACGTCAGAAAGAT-<br>GATCGCAAAGAGCGAACAGGAAATCGGAAAGGCAACAGCA | 132 |

| Description | Sequence | SEQ ID No. |
|---|---|---|
| | AAGTACTTCTTCTACAGCAACATCATGAACTTCTTCAAGACAGAAAT-<br>CACACTGGCAAACGGAGAAATCAGAAAGAGACCGCTGATCGAAACAA<br>ACGGAGAAACAGGAGAAATCGTCTGGGACAAGGGAAGA-<br>GACTTCGCAACAGTCAGAAAGGTCCTGAGCATGCCGCAGGTCAACATCGTCAAGAA<br>GACAGAAGTCCAGACAGGAGGAT-<br>TCAGCAAGGAAAGCATCCTGCCGAAGAGAAACAGCGACAAGCTGATCGCAAGAAAGAAGGACTGGGACCCG<br>AAGAAGTACGGAGGATTCGACAGCCCGACAGTCGCATA-<br>CAGCGTCCTGGTCGTCGCAAAGGTCGAAAAGGGAAAGAGCAAGAAGCTGAAGAGCG<br>TCAAGGAACTGCTGGGAATCACAATCATGGAAAGAAGCAGCTTCGAAAAGAACCC-<br>GATCGACTTCCTGGAAGCAAAGGGATACAAGGAAGTCAA<br>GAAGGACCTGATCATCAAGCTGCCGAAGTACAGCCTGTTCGAACTGGAAACG-<br>GAAGAAAGAGAATGCTGGCAAGCGCAGGAGAACTGCAGAAG<br>GGAAACGAACTGGCACTGCCGAGCAAGTACGTCAACTTCCTGTACCTGGCAAGCCAC-<br>TACGAAAAGCTGAAGGGAAGCCCGGAAGACAACGAAC<br>AGAAGCAGCTGTTCGTCGAACAGCACAAGCACTACCTGGACGAAATCATCGAACA-<br>GATCAGCGAATTCAGCAAGAGAGTCATCCTGGCAGACGC<br>AAACCTGGACAAGGTCCTGAGCGCATACAACAAGCACAGAGACAAGCC-<br>GATCAGAGAACAGGCAGAAAACATCATCCACCTGTTCACACTGACA<br>AACCTGGGAGCACCGGCAGCATTCAAGTACTTCGACACAACAATCGACAGAAAGAGATA-<br>CACAAGCACAAAGGAAGTCCTGGACGCAACACTGA<br>TCCACCAGAGCATCACAGGACTGTACGAAACAAGAATCGACCTGAGCCAGCTGGGAGGA-<br>GACGGAGGAGGAAGCCCGGCACCGGCAAAGAGAGA<br>AAGAACAACATAG | |
| Open reading frame for Cas9 with NLS4, with start and stop codons | ATGGACAAGAAGTACAGCATCGGACTGGACATCGGAACAAACAGCGTCGGATGGGCAGT-<br>CATCACAGACGAATACAAGGTCCCGAGCAAGAAGT<br>TCAAGGTCCTGGGAAACACAGACAGACAGCATCAAGAAGAACCTGATCG-<br>GAGCACTGCTGTTCGACAGCGGAGAAACAGCAGAAGCAACAAG<br>ACTGAAGAGAACAGCAAGAAGAAGATACAAGAAGAAAGAACAGAATCTGC-<br>TACCTGCAGGAAATCTTCAGCAACGAAATGGCAAAGGTCGAC<br>GACAGCTTCTTCCACAGACTGGAAGAAAGCTTCCTGGTCGAAGAA-<br>GACAAGAAGCACGAAAGACACCCGATCTTCGGAAACATCGTCGACGAAG<br>TCGCATACCACGAAAAGTACCCGACAATCTACCACCT-<br>GAGAAAGAAGCTGGTCGACAGCACAGACAAGGCAGACCTGAGACTGATCTACCTGGC<br>ACTGGCACACATGATCAAGTTCAGAGGACACTTCCTGATCGAAGGAGACCT-<br>GAACCCGGACAACAGCGACGTCGACAAGCTGTTCATCCAGCTG<br>GTCCAGACATACAACCAGCTGTTCGAAGAAAACCCGATCAACGCAAGCG-<br>GAGTCGACGCAAAGGCAATCCTGAGCGCAAGACTGAGCAAGACA<br>GAAGACTGGAAAACCTGATCGCACAGCTGCCGGGAGAAAAGAAGAACGGACTGTTCG-<br>GAAACCTGATCGCACTGAGCCTGGGACTGACACCGAA<br>CTTCAAGAGCAACTTCGACCTGGCAGAAGACGCAAAGCTGCAGCTGAGCAAGGACACAT-<br>ACGACGACGACCTGGACAACCTGCTGGCACAGATC<br>GGAGACCAGTACGCAGACCTGTTCCTGGCAGCAAAGAACCTGAGCGACGCAATCCTGCT-<br>GAGCGACATCCTGAGAGTCAACACAGAAATCACAA<br>AGGCACCGCTGAGCGCAAGCATGATCAAGAGATACGACGAACAC-<br>CACCAGGACCTGACACTGCTGAAGGCACTGGTCAGACAGCAGCTGCCGGA<br>AAAGTACAAGGAAATCTTCTTCGACCAGAGCAAGAACGGATACGCAGGATACATCGACG-<br>GAGGAGCAAGCCAGGAAGAATTCTACAAGTTCATC<br>AAGCCGATCCTGGAAAAGATGGACGGAACAGAAGAACTGCTGGTCAAGCTGAACAGAGAA-<br>GACCTGCTGAGAAAGCAGAGAACATTCGACAACG<br>GAAGCATCCCGCACCAGATCCACCTGGGAGAACTGCACGCAATCCTGAGAAGACAGGAA-<br>GACTTCTACCCGTTCCTGAAGGACAACAGAGAAAA<br>GATCGAAAAGATCCTGACATTCAGAATCCCGTACTACGTCGGACCGCTGGCAAGAG-<br>GAAACAGCAGATTCGCATGGATGACAAGAAAGAGCGAA<br>GAAACAATCACACCGTGGAACTTCGAAGAAGTCGTCGACAAGG-<br>GAGCAAGCGCACAGAGCTTCATCGAAAGAATGACAAACTTCGACAAGAACC<br>TGCCGAACGAAAAGGTCCTGCCGAAGCACAGCCTGCTGTACGAATACTTCACAGTCTA-<br>CAACGAACTGACAAAGGTCAAGTACGTCACAGAAGG<br>AATGAGAAAGCCGGCATTCCTGAGCGGAGAACAGAAGAAGGCAATCGTCGACCTGCTGTT-<br>CAAGACAAACAGAAAGGTCACAGTCAAGCAGCTG<br>AAGGAAGACTACTTCAAGAAGATCGAATGCTTCGACAGCGTCGAAATCAGCGGAGTCGAA-<br>GACAGATTCAACGCAAGCCTGGGAACATACCACG<br>ACCTGCTGAAGATCATCAAGGACAAGGACTTCCTGGACAACGAAGAAAACGAAGA-<br>CATCCTGGAAGACATCGTCCTGACACTGACACTGTTCGA<br>AGACAGAGAAATGATCGAAGAAGACTGAAGACATACGCACACCTGTTCGACGACAAGGT-<br>CATGAAGCAGCTGAAGAGAAGAAGATACACAGGA<br>TGGGGAAGACTGAGCAGAAAGCTGATCAACGGAATCAGAGACAAGCAGAGCGGAAA-<br>GACAATCCTGGACTTCCTGAAGAGCGACGGATTCGCAA<br>ACAGAAACTTCATGCAGCTGATCCACGACGACAGCCTGACATTCAAGGAAGA-<br>CATCCAGAAGGCACAGGTCAGCGGACAGGGAGACAGCCTGCA<br>CGAACACATCGCAAACCTGGCAGGAAGCCCGGCAATCAAGAAGGGAATCCTGCAGACAGT-<br>CAAGGTCGTCGACGAACTGGTCAAGGTCATGGGA<br>AGACACAAGCCGGAAAACATCGTCATCGAAATGGCAAGAGAAAACCA-<br>GACAACACAGAAGGGACAGAAGAACAGCAGAGAAAGAATGAAGAGAA<br>TCGAAGAAGGAATCAAGGAACTGGGAAGCCAGATCCT-<br>GAAGGAACACCCGGTCGAAAACACACAGCTGCAGAACGAAAAGCTGTACCTGTACTA | 133 |

| Description | Sequence | SEQ ID No. |
|---|---|---|
| | CCTGCAGAACGGAAGAGACATGTACGTCGACCAGGAACTGGACATCAACAGACT-<br>GAGCGACTACGACGTCGACCACATCGTCCCGCAGAGCTTC<br>CTGAAGGACGACAGCATCGACAACAAGGTCCTGACAAGAAGCGACAAGAACAGAG-<br>GAAAGAGCGACAACGTCCCGAGCGAAGAAGTCGTCAAGA<br>AGATGAAGAACTACTGGAGACAGCTGCTGAACGCAAAGCTGAT-<br>CACACAGAGAAAGTTCGACAACCTGACAAAGGCAGAGAGAGGAGGACTGAG<br>CGAACTGGACAAGGCAGGATTCATCAAGAGACAGCTGGTCGAAACAAGACAGAT-<br>CACAAAGCACGTCGCACAGATCCTGGACAGCAGAATGAAC<br>ACAAAGTACGACGAAAACGACAAGCTGATCAGAGAAGTCAAGGTCATCACACT-<br>GAAGAGCAAGCTGGTCAGCGACTTCAGAAAGGACTTCCAGT<br>TCTACAAGGTCAGAGAAATCAACAACTACCACCACGCACACGACGCATACCT-<br>GAACGCAGTCGTCGGAACAGCACTGATCAAGAAGTACCCGAA<br>GCTGGAAAGCGAATTCGTCTACGGAGACTACAAGGTCTACGACGTCAGAAAGAT-<br>GATCGCAAAGAGCGAACAGGAAATCGGAAAGGCAACAGCA<br>AAGTACTTCTTCTACAGCAACATCATGAACTTCTTCAAGACAGAAAT-<br>CACACTGGCAAACGGAGAAATCAGAAAGAGACCGCTGATCGAAACAA<br>ACGGAGAAACAGGAGAAATCGTCTGGGACAAGGGAAGA-<br>GACTTCGCAACAGTCAGAAAGGTCCTGAGCATGCCGCAGGTCAACATCGTCAAGAA<br>GACAGAAGTCCAGACAGGAGGAT-<br>TCAGCAAGGAAAGCATCCTGCCGAAGAGAAACAGCGACAAGCTGATCGCAAGAAAGAAGGACTGGGACCCG<br>AAGAAGTACGGAGGATTCGACAGCCCGACAGTCGCATA-<br>CAGCGTCCTGGTCGTCGCAAAGGTCGAAAAGGGAAAGAGCAAGAAGCTGAAGAGCG<br>TCAAGGAACTGCTGGGAATCACAATCATGGAAAGAAGCAGCTTCGAAAAGAACCC-<br>GATCGACTTCCTGGAAGCAAAGGGATACAAGGAAGTCAA<br>GAAGGACCTGATCATCAAGCTGCCGAAGTACAGCCTGTTCGAACTGGAAAACG-<br>GAAGAAAGAGAATGCTGGCAAGCGCAGGAGAACTGCAGAAG<br>GGAAACGAACTGGCACTGCCGAGCAAGTACGTCAACTTCCTGTACCTGGCAAGCCAC-<br>TACGAAAAGCTGAAGGGAAGCCCGGAAGACAACGAAC<br>AGAAGCAGCTGTTCGTCGAACAGCACAAGCACTACCTGGACGAAATCATCGAACA-<br>GATCAGCGAATTCAGCAAGAGAGTCATCCTGGCAGACGC<br>AAACCTGGACAAGGTCCTGAGCGCATACAACAAGCACAGAGACAAGCC-<br>GATCAGAGAACAGGCAGAAAACATCATCCACCTGTTCACACTGACA<br>AACCTGGGAGCACCGGCAGCATTCAAGTACTTCGACACAACAATCGACGAAAGAGATA-<br>CACAAGCACAAAGGAAGTCCTGGACGCAACACTGA<br>TCCACCAGAGCATCACAGGACTGTACGAAACAAGAATCGACCTGAGCCAGCTGGGAGGA-<br>GACGGAGGAGGAAGCCAGGCAGCAAAGAGACCGAG<br>AACAACATAG | |
| Open reading frame for Cas9 with NLS5, with start and stop codons | ATGGACAAGAAGTACAGCATCGGACTGGACATCGGAACAAACAGCGTCGGATGGGCAGT-<br>CATCACAGACGAATACAAGGTCCCGAGCAAGAAGT<br>TCAAGGTCCTGGGAAACACAGACAGACACAGCATCAAGAAGAACCTGATCG-<br>GAGCACTGCTGTTCGACAGCGGAGAAACAGCAGAAGCAACAAG<br>ACTGAAGAGAACAGCAAGAAGGAAGATACACAAGAAGAAAGAACAGAATCTGC-<br>TACCTGCAGGAAATCTTCAGCAACGAAATGGCAAAGGTCGAC<br>GACAGCTTCTTCCACAGACTGGAAGAAAGCTTCCTGGTCGAAGAA-<br>GACAAGAAGCACGAAAGACACCCGATCTTCGGAAACATCGTCGACGAAG<br>TCGCATACCACGAAAAGTACCCGACAATCTACCACCT-<br>GAGAAAGAAGCTGGTCGACAGCACAGACAAGGCAGACCTGAGACTGATCTACCTGGC<br>ACTGGCACACATGATCAAGTTCAGAGGACACTTCCTGATCGAAGGAGACCT-<br>GAACCCGGACAACAGCGACGTCGACAAGCTGTTCATCCAGCTG<br>GTCCAGACATACAACCAGCTGTTCGAAGAAAACCCGATCAACGCAAGCG-<br>GAGTCGACGCAAAGGCAATCCTGAGCGCAAGACTGAGCAAGAGCA<br>GAAGACTGGAAAACCTGATCGCACAGCTGCCGGGAGAAAAGAAGAACGGACTGTTCG-<br>GAAACCTGATCGCACTGAGCCTGGGACTGACACCGAA<br>CTTCAAGAGCAACTTCGACCTGGCAGAAGACGCAAAGCTGCAGCTGAGCAAGGACACAT-<br>ACGACGACGACCTGGACAACCTGCTGGCACAGATC<br>GGAGACCAGTACGCAGACCTGTTCCTGGCAGCAAAGAACCTGAGCGACGCAATCCTGCT-<br>GAGCGACATCCTGAGAGTCAACACAGAAATCACAA<br>AGGCACCGCTGAGCGCAAGCATGATCAAGAGATACGACGAACAC-<br>CACCAGGACCTGACACTGCTGAAGGCACTGGTCAGACAGCAGCTGCCGGA<br>AAAGTACAAGGAAATCTTCTTCGACCAGAGCGAAGAACGGATACGCAGGATACATCGACG-<br>GAGGAGCAAGCCAGGAAGAATTCTACAAGTTCATC<br>AAGCCGATCCTGGAAAAGATGGACGGAACAGAAGAACTGCTGGTCAAGCTGAACAGAGAA-<br>GACCTGCTGAGAAAGCAGAGAACATTCGACAACG<br>GAAGCATCCCGCACCAGATCCACCTGGGAGAACTGCACGCAATCCTGAGAAGACAGGAA-<br>GACTTCTACCCGTTCCTGAAGGACAACAGAGAAAA<br>GATCGAAAAGATCCTGACATTCAGAATCCCGTACTACGTCGGACCGCTGGCAAGAG-<br>GAAACAGCAGATTCGCATGGATGACAAGAAAGAGCGAA<br>GAAACAATCACACCGTGGAACTTCGAAGAAGTCGTCGACAAGG-<br>GAGCAAGCGCACAGAGCTTCATCGAAAGAATGACAAACTTCGACAAGAACC<br>TGCCGAACGAAAAGGTCCTGCCGAAGCACAGCCTGCTGTACGAATACTTCACAGTCTA-<br>CAACGAACTGACAAAGGTCAAGTACGTCACAGAAGG<br>AATGAGAAAGCCGGCATTCCTGAGCGGAGAACAGAAGAAGGCAATCGTCGACCTGCTGTT-<br>CAAGACAAACAGAAAGGTCACAGTCAAGCAGCTG<br>AAGGAAGACTACTTCAAGAAGATCGAATGCTTCGACAGCGTCGAAATCAGCGGAGTCGAA-<br>GACAGATTCAACGCAAGCCTGGGAACATACCACG | 134 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | ACCTGCTGAAGATCATCAAGGACAAGGACTTCCTGGACAACGAAGAAAACGAAGA-<br>CATCCTGGAAGACATCGTCCTGACACTGACACTGTTCGA<br>AGACAGAGAAATGATCGAAGAAAGACTGAAGACATACGCACACCTGTTCGACGACAAGGT-<br>CATGAAGCAGCTGAAGAGAAGAAGATACACAGGA<br>TGGGGAAGACTGAGCAGAAAGCTGATCAACGGAATCAGAGACAAGCAGAGCGGAAA-<br>GACAATCCTGGACTTCCTGAAGAGCGACGGATTCGCAA<br>ACAGAAACTTCATGCAGCTGATCCACGACGACAGCCTGACATTCAAGGAAGA-<br>CATCCAGAAGGCACAGGTCAGCGGACAGGGAGACAGCCTGCA<br>CGAACACATCGCAAACCTGGCAGGAAGCCCGGCAATCAAGAAGGGAATCCTGCAGACAGT-<br>CAAGGTCGTCGACGAACTGGTCAAGGTCATGGGA<br>AGACACAAGCCGGAAAACATCGTCATCGAAATGGCAAGAGAAAACCA-<br>GACAACACAGAAGGGACAGAAGAACAGCAGAGAAAGAATGAAGAGAA<br>TCGAAGAAGGAATCAAGGAACTGGGAAGCCAGATCCT-<br>GAAGGAACACCCGGTCGAAAACACACAGCTGCAGAACGAAAAGCTGTACCTGTACTA<br>CCTGCAGAACGAAGAGACATGTACGTCGACCAGGAACTGGACATCAACAGACT-<br>GAGCGACTACGACGTCGACCACATCGTCCCGCAGAGCTTC<br>CTGAAGGACGACAGCATCGACAACAAGGTCCTGACAAGAAGCGACAAGAACAGAG-<br>GAAAGAGCGACAACGTCCCGAGCGAAGAAGTCGTCAAGA<br>AGATGAAGAACTACTGGAGACAGCTGCTGAACGCAAAGCTGAT-<br>CACACACAGAGAAAGTTCGACAACCTGACAAAGGCAGAGAGAGGAGGACTGAG<br>CGAACTGGACAAGGCAGGATTCATCAAGAGACAGCTGGTCGAAACAAGACAGAT-<br>CACAAAGCACGTCGCACAGATCCTGGACAGCAGAATGAAC<br>ACAAAGTACGACGAAAACGACAAGCTGATCAGAGAAGTCAAGGTCATCACACT-<br>GAAGAGCAAGCTGGTCAGCGACTTCAGAAAGGACTTCCAGT<br>TCTACAAGGTCAGAGAAATCAACAACTACCACCACGCACACGACGCATACCT-<br>GAACGCAGTCGTCGGAACAGCACTGATCAAGAAGTACCCGAA<br>GCTGGAAAGCGAATTCGTCTACGGAGACTACAAGGTCTACGACGTCAGAAAGAT-<br>GATCGCAAAGAGCGAACAGGAAATCGGAAAGGCAACAGCA<br>AAGTACTTCTTCTACAGCAACATCATGAACTTCTTCAAGACAGAAAT-<br>CACACTGGCAAACGGAGAAATCAGAAAGAGACCGCTGATCGAAACAA<br>ACGGAGAAACAGGAGAAATCGTCTGGGACAAGGGAAGA-<br>GACTTCGCAACAGTCAGAAAGGTCCTGAGCATGCCGCAGGTCAACATCGTCAAGAA<br>GACAGAAGTCCAGACAGGAGGAT-<br>TCAGCAAGGAAAGCATCCTGCCGAAGAGAAACAGCGACAAGCTGATCGCAAGAAAGAAGGACTGGGACCCG<br>AAGAAGTACGGAGGATTCGACAGCCCGACAGTCGCATA-<br>CAGCGTCCTGGTCGTCGCAAAGGTCGAAAAGGGAAAGAGCAAGAAGCTGAAGAGCG<br>TCAAGGAACTGCTGGGAATCACAATCATGGAAAGAAGCAGCTTCGAAAAGAACCC-<br>GATCGACTTCCTGGAAGCAAAGGGATACAAGGAAGTCAA<br>GAAGGACCTGATCATCAAGCTGCCGAAGTACAGCCTGTTCGAACTGGAAAACG-<br>GAAGAAAGAGAATGCTGGCAAGCGCAGGAGAACTGCAGAAG<br>GGAAACGAACTGGCACTGCCGAGCAAGTACGTCAACTTCCTGTACCTGGCAAGCCAC-<br>TACGAAAAGCTGAAGGGAAGCCCGGAAGACAACGAAC<br>AGAAGCAGCTGTTCGTCGAACAGCACAAGCACTACCTGGACGAAATCATCGAACA-<br>GATCAGCGAATTCAGCAAGAGAGTCATCCTGGCAGACGC<br>AAACCTGGACAAGGTCCTGAGCGCATACAACAAGCACAGAGACAAGCC-<br>GATCAGAGAACAGGCAGAAAACATCATCCACCTGTTCACACTGACA<br>AACCTGGGAGCACCGGCAGCATTCAAGTACTTCGACACAACAATCGACAAAGAGATA-<br>CACAAGCACAAAGGAAGTCCTGGACGCAACACTGA<br>TCCACCAGAGCATCACAGGACTGTACGAAACAAGAATCGACCTGAGCCAGCTGGGAGGA-<br>GACGGAGGAGGAAGCAGAGCAGCAAAGAGACCGAG<br>AACAACATAG | |
| Open reading frame for Cas9 with NLS6, with start and stop codons | ATGGACAAGAAGTACAGCATCGGACTGGACATCGGAACAAACAGCGTCGGATGGGCAGT-<br>CATCACAGACGAATACAAGGTCCCGAGCAAGAAGT<br>TCAAGGTCCTGGGAAACACAGACAGACACAGCATCAAGAAGAACCTGATCG-<br>GAGCACTGCTGTTCGACAGCGGAGAAAACAGCAGAAGCAACAAG<br>ACTGAAGAGAACAGCAAGAAGAAGATACACAAGAAGAAAGAACAGAATCTGC-<br>TACCTGCAGGAAATCTTCAGCAACGAAATGGCAAAGGTCGAC<br>GACAGCTTCTTCCACAGACTGGAAGAAAGCTTCCTGGTCGAAGAA-<br>GACAAGAAGCACAAAGACACCCGATCTTCGGAAACATCGTCGACGAAG<br>TCGCATACCACGAAAAGTACCCGACAATCTACCACCT-<br>GAGAAAGAAGCTGGTCGACAGCACAGACAAGGCAGACCTGAGACTGATCTACCTGGC<br>ACTGGCACACATGATCAAGTTCAGAGGACACTTCCTGATCGAAGGAGACCT-<br>GAACCCGGACAACAGCGACGTCGACAAGCTGTTCATCCAGCTG<br>GTCCAGACATACAACCAGCTGTTCGAAGAAAACCCGATCAACGCAAGCG-<br>GAGTCGACGCAAAGGCAATCCTGAGCGCAAGACTGAGCAAGAGCA<br>GAAGACTGGAAAACCTGATCGCACAGCTGCCGGGAGAAAAGAAGAACGGACTGTTCG-<br>GAAACCTGATCGCACTGAGCCTGGGACTGACACCGAA<br>CTTCAAGAGCAACTTCGACCTGGCAGAAGACGCAAAGCTGCAGCTGAGCAAGGACACAT-<br>ACGACGACGACCTGGACAACCTGCTGGCACAGATC<br>GGAGACCAGTACGCAGACCTGTTCCTGGCAGCAAAGAACCTGAGCGACGCAATCCTGCT-<br>GAGCGACATCCTGAGAGTCAACACAGAAATCACAA<br>AGGCACCGCTGAGCGCAAGCATGATCAAGAGATACGACGAACAC-<br>CACCAGGACCTGACACTGCTGAAGGCACTGGTCAGACAGCAGCTGCCGGA<br>AAAGTACAAGGAAATCTTCTTCGACCAGAGCAAGAACGGATACGCAGGATACATCGACG-<br>GAGGAGCAAGCCAGGAAGAATTCTACAAGTTCATC | 135 |

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | AAGCCGATCCTGGAAAAGATGGACGGAACAGAAGAACTGCTGGTCAAGCTGAACAGAGAA-GACCTGCTGAGAAAGCAGAGAACATTCGACAACG<br>GAAGCATCCCGCACCAGATCCACCTGGGAGAACTGCACGCAATCCTGAGAAGACAGGAA-GACTTCTACCCGTTCCTGAAGGACAACAGAGAAAA<br>GATCGAAAAGATCCTGACATTCAGAATCCCGTACTACGTCGGACCGCTGGCAAGAG-GAAACAGCAGATTCGCATGGATGACAAGAAAGAGCGAA<br>GAAACAATCACACCGTGGAACTTCGAAGAAGTCGTCGACAAGG-GAGCAAGCGCACAGAGCTTCATCGAAAGAATGACAAACTTCGACAAGAACC<br>TGCCGAACGAAAAGGTCCTGCCGAAGCACAGCCTGCTGTACGAATACTTCACAGTCTA-CAACGAACTGACAAAGGTCAAGTACGTCACAGAAGG<br>AATGAGAAAGCCGGCATTCCTGAGCGGAGAACAGAAGAAGGCAATCGTCGACCTGCTGTT-CAAGACAAACAGAAAGGTCACAGTCAAGCAGCTG<br>AAGGAAGACTACTTCAAGAAGATCGAATGCTTCGACAGCGTCGAAATCAGCGGAGTCGAA-GACAGATTCAACGCAAGCCTGGGAACATACCACG<br>ACCTGCTGAAGATCATCAAGGACAAGGACTTCCTGGACAACGAAGAAAACGAAGA-CATCCTGGAAGACATCGTCCTGACACTGACACTGTTCGA<br>AGACAGAGAAATGATCGAAGAAAGACTGAAGACATACGCACACCTGTTCGACGACAAGGT-CATGAAGCAGCTGAAGAGAAGAAGATACACAGGA<br>TGGGGAAGACTGAGCAGAAAGCTGATCAACGGAATCAGAGACAAGCAGAGCGGAAA-GACAATCCTGGACTTCCTGAAGAGCGACGGATTCGCAA<br>ACAGAAACTTCATGCAGCTGATCCACGACGACAGCCTGACATTCAAGGAAGA-CATCCAGAAGGCACAGGTCAGCGGACAGGGAGACAGCCTGCA<br>CGAACACATCGCAAACCTGGCAGGAAGCCCGGCAATCAAGAAGGGAATCCTGCAGACAGT-CAAGGTCGTCGACGAACTGCAAGGTCATGGGA<br>AGACACAAGCCGGAAAACATCGTCATCGAAATGGCAAGAGAAAACCA-GACAACACAGAAGGGACAGAAGAACAGCAGAGAAAGAATGAAGAGAA<br>TCGAAGAAGGAATCAAGGAACTGGGAAGCCAGATCCT-GAAGGAACACCCGGTCGAAAACACACAGCTGCAGAACGAAAAGCTGTACCTGTACTA<br>CCTGCAGAACGGAAGAGACATGTACGTCGACCAGGAACTGGACATCAACAGACT-GAGCGACTACGACGTCGACCACATCGTCCCGCAGAGCTTC<br>CTGAAGGACGACAGCATCGACAACAAGGTCCTGACAAGAAGCGACAAGAACAGAG-GAAAGAGCGACAACGTCCCGAGCGAAGAAGTCGTCAAGA<br>AGATGAAGAACTACTGGAGACAGCTGCTGAACGCAAAGCTGAT-CACACAGAGAAAGTTCGACAACCTGACAAAGGCAGAGAGAGGAGGACTGAG<br>CGAACTGGACAAGGCAGGATTCATCAAGAGACAGCTGGTCGAAACAAGACAGAT-CACAAAGCACGTCGCACAGATCCTGGACAGCAGAATGAAC<br>ACAAAGTACGACGAAAACGACAAGCTGATCAGAGAAGTCAAGGTCATCACACT-GAAGAGCAAGCTGGTCAGCGACTTCAGAAAGGACTTCCAGT<br>TCTACAAGGTCAGAGAAATCAACAACTACCACCACGCACACGACGCATACCT-GAACGCAGTCGTCGGAACAGCACTGATCAAGAAGTACCCGAA<br>GCTGGAAAGCGAATTCGTCTACGGAGACTACAAGGTCTACGACGTCAGAAAGAT-GATCGCAAAGAGCGAACAGGAAATCGGAAAGGCAACAGCA<br>AAGTACTTCTTCTACAGCAACATCATGAACTTCTTCAAGACAGAAAT-CACACTGGCAAACGGAGAAATCAGAAAGAGACCGCTGATCGAAACAA<br>ACGGAGAAACAGGAGAAATCGTCTGGGACAAGGGAAGA-GACTTCGCAACAGTCAGAAAGGTCCTGAGCATGCCGCAGGTCAACATCGTCAAGAA<br>GACAGAAGTCCAGACAGGAGGAT-TCAGCAAGGAAAGCATCCTGCCGAAGAGAAACAGCGACAAGCTGATCGCAAGAAAGAAGGACTGGGACCCG<br>AAGAAGTACGGAGGATTCGACAGCCCGACAGTCGCATA-CAGCGTCCTGGTCGTCGCAAAGGTCGAAAAGGGAAAGAGCAAGAAGCTGAAGAGCG<br>TCAAGGAACTGCTGGGAATCACAATCATGGAAAGAAGCAGCTTCGAAAAGAACCC-GATCGACTTCCTGGAAGCAAAGGGATACAAGGAAGTCAA<br>GAAGGACCTGATCATCAAGCTGCCGAAGTACAGCCTGTTCGAACTGGAAAACG-GAAGAAAGAGAATGCTGGCAAGCGCAGGAGAACTGCAGAAG<br>GGAAACGAACTGGCACTGCCGAGCAAGTACGTCAACTTCCTGTACCTGGCAAGCCAC-TACGAAAAGCTGAAGGGAAGCCCGGAAGACAACGAAC<br>AGAAGCAGCTGTTCGTCGAACAGCACAAGCACTACCTGGACGAAATCATCGAACA-GATCAGCGAATTCAGCAAGAGAGTCATCCTGGCAGACGC<br>AAACCTGGACAAGGTCCTGAGCGCATACAACAAGCACAGAGACAAGCC-GATCAGAGAACAGGCAGAAAACATCATCCACCTGTTCACACTGACA<br>AACCTGGGAGCACCGGCAGCATTCAAGTACTTCGACACAACAATCGACAGAAAGAGATA-CACAAGCACAAAGGAAGTCCTGGACGCAACACTGA<br>TCCACCAGAGCATCACAGGACTGTACGAAACAAGAATCGACCTGAGCCAGCTGGGAGGA-GACGGAGGAGGAAGCGCAGCAGCAAAGAGAAGCTG<br>GAGCATGGCAGCATAG | |
| Open reading frame for Cas9 | ATGGACAAGAAGTACAGCATCGGACTGGACATCGGAACAAACAGCGTCGGATGGGCAGT-CATCACAGACGAATACAAGGTCCCGAGCAAGAAGT<br>TCAAGGTCCTGGGAAACACAGACAGACACAGCATCAAGAAGAACCTGATCG-GAGCACTGCTGTTCGACAGCGGAGAAACAGCAGAAGCAACAAG<br>ACTGAAGAGAACAGCAAGAAGAAGATACACAAGAAGAAAGAACAGAATCTGC-TACCTGCAGGAAATCTTCAGCAACGAAATGGCAAAGGTCGAC<br>GACAGCTTCTTCCACAGACTGGAAGAAAGCTTCCTGGTCGAAGAA-GACAAGAAGCACGAAAGACACCCGATCTTCGGAAACATCGTCGACGAAG<br>TCGCATACCACGAAAAGTACCCGACAATCTACCACCT-GAGAAAGAAGCTGGTCGACAGCACAGACAAGGCAGACCTGAGACTGATCTACCTGGC | 136 |

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| with NLS7, with start and stop codons | ACTGGCACACATGATCAAGTTCAGAGGACACTTCCTGATCGAAGGAGACCT-GAACCCGGACAACAGCGACGTCGACAAGCTGTTCATCCAGCTG GTCCAGACATACAACCAGCTGTTCGAAGAAACCCGATCAACGCAAGCG-GAGTCGACGCAAAGGCAATCCTGAGCGCAAGACTGAGCAAGAGCA GAAGACTGGAAAACCTGATCGCACAGCTGCCGGGAGAAAAGAAGAACGGACTGTTCG-GAAACCTGATCGCACTGAGCCTGGGACTGACACCGAA CTTCAAGAGCAACTTCGACCTGGCAGAAGACGCAAAGCTGCAGCTGAGCAAGGACACAT-ACGACGACGACCTGGACAACCTGCTGGCACAGATC GGAGACCAGTACGCAGACCTGTTCCTGGCAGCAAAGAACCTGAGCGACGCAATCCTGCT-GAGCGACATCCTGAGAGTCAACACAGAAATCACAA AGGCACCGCTGAGCGCAAGCATGATCAAGAGATACGACGAACAC-CACCAGGACCTGACACTGCTGAAGGCACTGGTCAGACAGCAGCTGCCGGA AAAGTACAAGGGAAATCTTCTTCGACCAGAGCAAGAACGGATACGCAGGATACATCGACG-GAGGAGCAAGCCAGGAAGAATTCTACAAGTTCATC AAGCCGATCCTGGAAAAGATGGACGGAACAGAAGAACTGCTGGTCAAGCTGAACAGAGAA-GACCTGCTGAGAAAGCAGAGAACATTCGACAACG GAAGCATCCCGCACCAGATCCACCTGGGAGAACTGCACGCAATCCTGAGAAGACAGGAA-GACTTCTACCCGTTCCTGAAGGACAACAGAGAAAA GATCGAAAAGATCCTGACATTCAGAATCCCGTACTACGTCGGACCGCTGGCAAGAG-GAAACAGCAGATTCGCATGGATGACAAGAAAGAGCGAA GAAACAATCACACCGTGGAACTTCGAAGAAGTCGTCGACAAGG-GAGCAAGCGCACAGAGCTTCATCGAAAGAATGACAAACTTCGACAAGAACC TGCCGAACGAAAAGGTCCTGCCGAAGCACAGCCTGCTGTACAATACTTCACAGTCTA-CAACGAACTGACAAAGGTCAAGTACGTCACAGAAGG AATGAGAAAGCCGGCATTCCTGAGCGGAGAACAGAAGAAGGCAATCGTCGACCTGCTGTT-CAAGACAAACAGAAAGGTCACAGTCAAGCAGCTG AAGGAAGACTACTTCAAGAAGATCGAATGCTTCGACAGCGTCGAAATCAGCGGAGTCGAA-GACAGATTCAACGCAAGCCTGGGAACATACCACG ACCTGCTGAAGATCATCAAGGACAAGGACTTCCTGGACAACGAAGAAAACGAAGA-CATCCTGGAAGACATCGTCCTGACACTGACACTGTTCGA AGACAGAGAAATGATCGAAGAAAGACTGAAGACATACGCACACCTGTTCGACGACAAGGT-CATGAAGCAGCTGAAGAGAAGAAGATACACAGGA TGGGGAAGACTGAGCAGAAAGCTGATCAACGGAATCAGAGACAAGCAGAGCGGAAA-GACAATCCTGGACTTCCTGAAGAGCGACGGATTCGCAA ACAGAAACTTCATGCAGCTGATCCACGACGACAGCCTGACATTCAAGGAAGA-CATCCAGAAGGCACAGGTCAGCGGACAGGGAGACAGCCTGCA CGAACACATCGCAAACCTGGCAGGAAGCCCGGCAATCAAGAAGGGAATCCTGCAGACAGT-CAAGGTCGTCGACGAACTGGTCAAGGTCATGGGA AGACACAAGCCGGAAAACATCGTCATCGAAATGGCAAGAGAAAACCA-GACAACACAGAAGGGACAGAAGAACAGCAGAGAAAGAATGAAGAGAA TCGAAGAAGGAATCAAGGAACTGGGAAGCCAGATCCT-GAAGGAACACCCGGTCGAAAACACACAGCTGCAGAACGAAAAGCTGTACCTGTACTA CCTGCAGAACGGAAGAGACATGTACGTCGACCAGGAACTGGACATCAACAGACT-GAGCGACTACGACGTCGACCACATCGTCCCGCAGAGCTTC CTGAAGGACGACAGCATCGACAACAAGGTCCTGACAAGAAGCGACAAGAACAGAG-GAAAGAGCGACAACGTCCCGAGCGAAGAAGTCGTCAAGA AGATGAAGAACTACTGGAGACAGCTGCTGAACGCAAAGCTGAT-CACACAGAGAAAGTTCGACAACCTGACAAAGGCAGAGAGAGGAGGACTGAG CGAACTGGACAAGGCAGGATTCATCAAGAGACAGCTGGTCGAAACAAGACAGAT-CACAAAGCACGTCGCACAGATCCTGGACAGCAGAATGAAC ACAAAGTACGACGAAAACGACAAGCTGATCAGAGAAGTCAAGGTCATCACACT-GAAGAGCAAGCTGGTCAGCGACTTCAGAAAGGACTTCCAGT TCTACAAGGTCAGAGAAATCAACAACTACCACCACGCACACGACGCATACCT-GAACGCAGTCGTCGGAACAGCACTGATCAAGAAGTACCCGAA GCTGGAAAGCGAATTCGTCTACGGAGACTACAAGGTCTACGACGTCAGAAAGAT-GATCGCAAAGAGCGAACAGGAAATCGGAAAGGCAACAGCA AAGTACTTCTTCTACAGCAACATCATGAACTTCTTCAAGACAGAAAT-CACACTGGCAAACGGAGAAATCAGAAAGAGACCGCTGATCGAAACAA ACGGAGAAACAGGAGAAATCGTCTGGGACAAGGGAAGA-GACTTCGCAACAGTCAGAAAGGTCCTGAGCATGCCGCAGGTCAACATCGTCAAGAA GACAGAAGTCCAGACAGGAGGAT-TCAGCAAGGAAAGCATCCTGCCGAAGAGAAACAGCGACAAGCTGATCGCAAGAAAGAAGGACTGGGACCCG AAGAAGTACGGAGGATTCGACAGCCCGACAGTCGCATA-CAGCGTCCTGGTCGTCGCAAAGGTCGAAAAGGGAAAGAGCAAGAAGCTGAAGAGCG TCAAGGAACTGCTGGGAATCACAATCATGGAAAGAAGCAGCTTCGAAAAGAACCC-GATCGACTTCCTGGAAGCAAAGGGATACAAGGAAGTCAA GAAGGACCTGATCATCAAGCTGCCGAAGTACAGCCTGTTCGAACTGGAAAACG-GAAGAAAGAGAATGCTGGCAAGCGCAGGAGAACTGCAGAAG GGAAACGAACTGGCACTGCCGAGCAAGTACGTCAACTTCCTGTACCTGGCAAGCCAC-TACGAAAAGCTGAAGGGAAGCCCGGAAGACAACGAAC AGAAGCAGCTGTTCGTCGAACAGCACAAGCACTACCTGGACGAAATCATCGAACA-GATCAGCGAATTCAGCAAGAGAGTCATCCTGGCAGACGC AAACCTGGACAAGGTCCTGAGCGCATACAACAAGCACAGAGACAAGCC-GATCAGAGAACAGGCAGAAAACATCATCCACCTGTTCACACTGACA AACCTGGGAGCACCGGCAGCATTCAAGTACTTCGACACAACAATCGACAGAAAGAGATA-CACAAGCACAAAGGAAGTCCTGGACGCAACACTGA | |

-continued

Sequence Table
The following sequence table provides a listing of sequences disclosed herein. It is understood that if a DNA sequence (comprising Ts) is referenced with respect to an RNA, then Ts should be replaced with Us(which may be modified or unmodified depending on the context), and vice versa.

| Description | Sequence | SEQ ID No. |
| --- | --- | --- |
| | TCCACCAGAGCATCACAGGACTGTACGAAACAAGAATCGACCTGAGCCAGCTGGGAGGA-<br>GACGGAGGAGGAAGCGCAGCAGCAAAGAGAGTCTG<br>GAGCATGGCATTCTAG | |
| Open reading frame for Cas9 with NLS8, with start and stop codons | ATGGACAAGAAGTACAGCATCGGACTGGACATCGGAACAAACAGCGTCGGATGGGCAGT-<br>CATCACAGACGAATACAAGGTCCCGAGCAAGAAGT<br>TCAAGGTCCTGGGAAACACAGACAGACAGCATCAAGAAGAACCTGATCG-<br>GAGCACTGCTGTTCGACAGCGGAGAAACAGCAGAAGCAACAAG<br>ACTGAAGAGAACAGCAAGAAGAAGATACACAAGAAGAAAGAACAGAATCTGC-<br>TACCTGCAGGAAATCTTCAGCAACGAAATGGCAAAGGTCGAC<br>GACAGCTTCTTCCACAGACTGGAAGAAAGCTTCCTGGTCGAAGAA-<br>GACAAGAAGCACGAAAGACACCCGATCTTCGGAAACATCGTCGACGAAG<br>TCGCATACCACGAAAAGTACCCGACAATCTACCACCT-<br>GAGAAAGAAGCTGGTCGACAGCACAGACAAGGCAGACCTGAGACTGATCTACCTGGC<br>ACTGGCACACATGATCAAGTTCAGAGGACACTTCCTGATCGAAGGAGACCT-<br>GAACCCGGACAACAGCGACGTCGACAAGCTGTTCATCCAGCTG<br>GTCCAGACATACAACCAGCTGTTCGAAGAAAACCCGATCAACGCAAGCG-<br>GAGTCGACGCAAAGGCAATCCTGAGCGCAAGACTGAGCAAGAGCA<br>GAAGACTGGAAAACCTGATCGCACAGCTGCCGGGAGAAAAGAAGAACGGACTGTTCG-<br>GAAACCTGATCGCACTGAGCCTGGGACTGACACCGAA<br>CTTCAAGAGCAACTTCGACCTGGCAGAAGACGCAAAGCTGCAGCTGAGCAAGGACACAT-<br>ACGACGACGACCTGGACAACCTGCTGGCACAGATC<br>GGAGACCAGTACGCAGACCTGTTCCTGGCAGCAAAGAACCTGAGCGACGCAATCCTGCT-<br>GAGCGACATCCTGAGAGTCAACACAGAAATCACAA<br>AGGCACCGCTGAGCGCAAGCATGATCAAGAGATACGACGAACAC-<br>CACCAGGACCTGACACTGCTGAAGGCACTGGTCAGACAGCAGCTGCCGGA<br>AAAGTACAAGGAAATCTTCTTCGACCAGAGCAAGAACGGATACGCAGGATACATCGACG-<br>GAGGAGCAAGCCAGGAAGAATTCTACAAGTTCATC<br>AAGCCGATCCTGGAAAAGATGGACGGAACAGAAGAACTGCTGGTCAAGCTGAACAGAGAA-<br>GACCTGCTGAGAAAGCAGAGAACATTCGACAACG<br>GAAGCATCCCGCACCAGATCCACCTGGGAGAACTGCACGCAATCCTGAGAAGACAGGAA-<br>GACTTCTACCCGTTCCTGAAGGACAACAGAGAAAA<br>GATCGAAAAGATCCTGACATTCAGAATCCCGTACTACGTCGGACCGCTGGCAAGAG-<br>GAAACAGCAGATTCGCATGGATGACAAGAAAGAGCGAA<br>GAAACAATCACACCGTGGAACTTCGAAGAAGTCGTCGACAAGG-<br>GAGCAAGCGCACAGAGCTTCATCGAAGAATGACAAACTTCGACAAGAACC<br>TGCCGAACGAAAAGGTCCTGCCGAAGCACAGCCTGCTGTACGAATACTTCACAGTCTA-<br>CAACGAACTGACAAAGGTCAAGTACGTCACAGAAGG<br>AATGAGAAAGCCGGCATTCCTGAGCGGAGAACAGAAGAAGGCAATCGTCGACCTGCTGTT-<br>CAAGACAAACAGAAAGGTCACAGTCAAGCAGCTG<br>AAGGAAGACTACTTCAAGAAGATCGAATGCTTCGACAGCGTCGAAATCAGCGGAGTCGAA-<br>GACAGATTCAACGCAAGCCTGGGAACATACCACG<br>ACCTGCTGAAGATCATCAAGGACAAGGACTTCCTGGACAACGAAGAAAACGAAGA-<br>CATCCTGGAAGACATCGTCCTGACACTGACACTGTTCGA<br>AGACAGAGAAATGATCGAAGAAAGACTGAAGACATACGCACACCTGTTCGACGACAAGGT-<br>CATGAAGCAGCTGAAGAGAAGAAGATACACAGGA<br>TGGGGAAGACTGAGCAGAAAGCTGATCAACGGAATCAGAGACAAGCAGAGCGGAAA-<br>GACAATCCTGGACTTCCTGAAGAGCGACGGATTCGCAA<br>ACAGAAACTTCATGCAGCTGATCCACGACGACAGCCTGACATTCAAGGAAGA-<br>CATCCAGAAGGCACAGGTCAGCGGACAGGGAGACAGCCTGCA<br>CGAACACATCGCAAACCTGGCAGGAAGCCCGGCAATCAAGAAGGGAATCCTGCAGACAGT-<br>CAAGGTCGTCGACGAACTGGTCAAGGTCATGGGA<br>AGACACAAGCCGGAAAACATCGTCATCGAAATGGCAAGAGAAAACCA-<br>GACAACACAGAAGGGACAGAAGAACAGCAGAGAAAGAATGAAGAGAA<br>TCGAAGAAGGAATCAAGGAACTGGGAAGCCAGATCCT-<br>GAAGGAACACCCGGTCGAAAACACACAGCTGCAGAACGAAAAGCTGTACCTGTACTA<br>CCTGCAGAACGGAAGAGACATGTACGTCGACCAGGAACTGGACATCAACAGACT-<br>GAGCGACTACGACGTCGACCACATCGTCCCGCAGAGCTTC<br>CTGAAGGACGACAGCATCGACAACAAGGTCCTGACAAGAAGCGACAAGAACAGAG-<br>GAAAGAGCGACAACGTCCCGAGCGAAGAAGTCGTCAAGA<br>AGATGAAGAACTACTGGAGACAGCTGCTGAACGCAAAGCTGAT-<br>CACACAGAGAAAGTTCGACAACCTGACAAAGGCAGAGAGGAGGACTGAG<br>CGAACTGGACAAGGCAGGATTCATCAAGAGACAGCTGGTCGAAACAAGACAGAT-<br>CACAAAGCACGTCGCACAGATCCTGGACAGCAGAATGAAC<br>ACAAAGTACGACGAAAACGACAAGCTGATCAGAGAAGTCAAGGTCATCACACT-<br>GAAGAGCAAGCTGGTCAGCGACTTCAGAAAGGACTTCCAGT<br>TCTACAAGGTCAGAGAAATCAACAACTACCACCACGCACACGACGCATACCT-<br>GAACGCAGTCGTCGGAACAGCACTGATCAAGAAGTACCCGAA<br>GCTGGAAAGCGAATTCGTCTACGGAGACTACAAGGTCTACGACGTCAGAAAGAT-<br>GATCGCAAAGAGCGAACAGGAAATCGGAAAGGCAACAGCA<br>AAGTACTTCTTCTACAGCAACATCATGAACTTCTTCAAGACAGAAAT-<br>CACACTGGCAAACGGAGAAATCAGAAAGAGACCGCTGATCGAAACAA<br>ACGGAGAAACAGGAGAAATCGTCTGGGACAAGGGAAGA-<br>GACTTCGCAACAGTCAGAAAGGTCCTGAGCATGCCGCAGGTCAACATCGTCAAGAA<br>GACAGAAGTCCAGACAGGAGGAT-<br>TCAGCAAGGAAAGCATCCTGCCGAAGAGAAACAGCGACAAGCTGATCGCAAGAAAGAAGGACTGGGACCCG | 137 |

| Description | Sequence | SEQ ID No. |
|---|---|---|
| | AAGAAGTACGGAGGATTCGACAGCCCGACAGTCGCATA-<br>CAGCGTCCTGGTCGTCGCAAAGGTCGAAAAGGGAAAGAGCAAGAAGCTGAAGAGCG<br>TCAAGGAACTGCTGGGAATCACAATCATGGAAAGAAGCAGCTTCGAAAAGAACCC-<br>GATCGACTTCCTGGAAGCAAAGGGATACAAGGAAGTCAA<br>GAAGGACCTGATCATCAAGCTGCCGAAGTACAGCCTGTTCGAACTGGAAAACG-<br>GAAGAAAGAGAATGCTGGCAAGCGCAGGAGAACTGCAGAAG<br>GGAAACGAACTGGCACTGCCGAGCAAGTACGTCAACTTCCTGTACCTGGCAAGCCAC-<br>TACGAAAAGCTGAAGGGAAGCCCGGAAGACAACGAAC<br>AGAAGCAGCTGTTCGTCGAACAGCACAAGCACTACCTGGACGAAATCATCGAACA-<br>GATCAGCGAATTCAGCAAGAGAGTCATCCTGGCAGACGC<br>AAACCTGGACAAGGTCCTGAGCGCATACAACAAGCACAGAGACAAGCC-<br>GATCAGAGAACAGGCAGAAAACATCATCCACCTGTTCACACTGACA<br>AACCTGGGAGCACCGGCAGCATTCAAGTACTTCGACACAACAATCGACGAAAGAGATA-<br>CACAAGCACAAAGGAAGTCCTGGACGCAACACTGA<br>TCCACCAGAGCATCACAGGACTGTACGAAACAAGAATCGACCTGAGCCAGCTGGGAGGA-<br>GACGGAGGAGGAAGCGCAGCAGCAAAGAGAAGCTG<br>GAGCATGGCATTCTAG | |
| Open<br>reading<br>frame<br>for<br>Cas9<br>with<br>NLS9,<br>with<br>start<br>and<br>stop<br>codons | ATGGACAAGAAGTACAGCATCGGACTGGACATCGGAACAAACAGCGTCGGATGGGCAGT-<br>CATCACAGACGAATACAAGGTCCCGAGCAAGAAGT<br>TCAAGGTCCTGGGAAACACAGACAGACACAGCATCAAGAAGAACCTGATCG-<br>GAGCACTGCTGTTCGACAGCGGAGAAACAGCAGAAGCAACAAG<br>ACTGAAGAGAACAGCAAGAAGAAGATACACAAGAAGAAAGAACAGAATCTGC-<br>TACCTGCAGGAAATCTTCAGCAACGAAATGGCAAAGGTCGAC<br>GACAGCTTCTTCCACAGACTGGAAGAAAGCTTCCTGGTCGAAGAA-<br>GACAAGAAGCACGAAAGACACCCGATCTTCGGAAACATCGTCGACGAAG<br>TCGCATACCACGAAAAGTACCCGACAATCTACCACCT-<br>GAGAAAGAAGCTGGTCGACAGCACAGACAAGGCAGACCTGAGACTGATCTACCTGGC<br>ACTGGCACACATGATCAAGTTCAGAGGACACTTCCTGATCGAAGGAGACCT-<br>GAACCCGGACAACAGCGACGTCGACAAGCTGTTCATCCAGCTG<br>GTCCAGACATACAACCAGCTGTTCGAAGAAAACCCGATCAACGCAAGCG-<br>GAGTCGACGCAAAGGCAATCCTGAGCGCAAGACTGAGCAAGAGCA<br>GAAGACTGGAAAACCTGATCGCACAGCTGCCGGGAGAAAAGAAGAACGGACTGTTCG-<br>GAAACCTGATCGCACTGAGCCTGGGACTGACACCGAA<br>CTTCAAGAGCAACTTCGACCTGGCAGAAGACGCAAAGCTGCAGCTGAGCAAGGACACAT-<br>ACGACGACGACCTGGACAACCTGCTGGCACAGATC<br>GGAGACCAGTACGCAGACCTGTTCCTGGCAGCAAAGAACCTGAGCGACGCAATCCTGCT-<br>GAGCGACATCCTGAGAGTCAACACAGAAATCACAA<br>AGGCACCGCTGAGCGCAAGCATGATCAAGAGATACGACGAACAC-<br>CACCAGGACCTGACACTGCTGAAGGCACTGGTCAGACAGCAGCTGCCGGA<br>AAAGTACAAGGAAATCTTCTTCGACCAGAGCAAGAACGGATACGCAGGATACATCGACG-<br>GAGGAGCAAGCCAGGAAGAATTCTACAAGTTCATC<br>AAGCCGATCCTGGAAAAGATGGACGGAACAGAAGAACTGCTGGTCAAGCTGAACAGAGAA-<br>GACCTGCTGAGAAAGCAGAGAACATTCGACAACG<br>GAAGCATCCCGCACCAGATCCACCTGGGAGAACTGCACGCAATCCTGAGAAGACAGGAA-<br>GACTTCTACCCGTTCCTGAAGGACAACAGAGAAAA<br>GATCGAAAAGATCCTGACATTCAGAATCCCGTACTACGTCGGACCGCTGGCAAGAG-<br>GAAACAGCAGATTCGCATGGATGACAAGAAAGAGCGAA<br>GAAACAATCACACCGTGGAACTTCGAAGAAGTCGTCGACAAGG-<br>GAGCAAGCGCACAGAGCTTCATCGAAAGAATGACAAACTTCGACAAGAACC<br>TGCCGAACGAAAAGTCCTGCCGAAGCACAGCCTGCTGTACGAATACTTCACAGTCTA-<br>CAACGAACTGACAAAGGTCAAGTACGTCACAGAAGG<br>AATGAGAAAGCCGGCATTCCTGAGCGGAGAACAGAAGAAGGCAATCGTCGACCTGCTGTT-<br>CAAGACAAACAGAAAGGTCACAGTCAAGCAGCTG<br>AAGGAAGACTACTTCAAGAAGATCGAATGCTTCGACAGCGTCGAAATCAGCGGAGTCGAA-<br>GACAGATTCAACGCAAGCCTGGGAACATACCACG<br>ACCTGCTGAAGATCATCAAGGACAAGGACTTCCTGGACAACGAAGAAAACGAAGA-<br>CATCCTGGAAGACATCGTCCTGACACTGACACTGTTCGA<br>AGACAGAGAAATGATCGAAGAAAGACTGAAGACATACGCACACCTGTTCGACGACAAGGT-<br>CATGAAGCAGCTGAAGAGAAGAAGATACACAGGA<br>TGGGGAAGACTGAGCAGAAAGCTGATCAACGGAATCAGAGACAAGCAGAGCGGAAA-<br>GACAATCCTGGACTTCCTGAAGAGCGACGGATTCGCAA<br>ACAGAAACTTCATGCAGCTGATCCACGACGACAGCCTGACATTCAAGGAAGA-<br>CATCCAGAAGGCACAGGTCAGCGGACAGGGAGACAGCCTGCA<br>CGAACACATCGCAAACCTGGCAGGAAGCCCGGCAATCAAGAAGGGAATCCTGCAGACAGT-<br>CAAGGTCGTCGACGAACTGGTCAAGGTCATGGGA<br>AGACACAAGCCGGAAAACATCGTCATCGAAATGGCAAGAGAAAACCA-<br>GACAACACAGAAGGGACAGAAGAACAGCAGAGAAAGAATGAAGAAA<br>TCGAAGAAGGAATCAAGGAACTGGGAAGCCAGATCCT-<br>GAAGGAACACCCGGTCGAAAACACACAGCTGCAGAACGAAAAGCTGTACCTGTACTA<br>CCTGCAGAACGGAAGAGACATGTACGTCGACCAGGAACTGGACATCAACAGACT-<br>GAGCGACTACGACGTCGACCACATCGTCCCGCAGAGCTTC<br>CTGAAGGACGACAGCATCGACAACAAGGTCCTGACAAGAAGCGACAAGAACAGAG-<br>GAAAGAGCGACAACGTCCCGAGCGAAGAAGTCGTCAAGA<br>AGATGAAGAACTACTGGAGACAGCTGCTGAACGCAAAGCTGAT-<br>CACACAGAGAAAGTTCGACAACCTGACAAAGGCAGAGAGAGGAGGACTGAG | 138 |

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | CGAACTGGACAAGGCAGGATTCATCAAGAGACAGCTGGTCGAAACAAGACAGAT-<br>CACAAAGCACGTCGCACAGATCCTGGACAGCAGAATGAAC<br>ACAAAGTACGACGAAAACGACAAGCTGATCAGAGAAGTCAAGGTCATCACACT-<br>GAAGAGCAAGCTGGTCAGCGACTTCAGAAAGGACTTCCAGT<br>TCTACAAGGTCAGAGAAATCAACAACTACCACCACGCACACGACGCATACCT-<br>GAACGCAGTCGTCGGAACAGCACTGATCAAGAAGTACCCGAA<br>GCTGGAAAGCGAATTCGTCTACGGAGACTACAAGGTCTACGACGTCAGAAAGAT-<br>GATCGCAAAGAGCGAACAGGAAATCGGAAAGGCAACAGCA<br>AAGTACTTCTTCTACAGCAACATCATGAACTTCTTCAAGACAGAAAT-<br>CACACTGGCAAACGGAGAAATCAGAAAGAGACCGCTGATCGAAACAA<br>ACGGAGAAACAGGAGAAATCGTCTGGGACAAGGGAAGA-<br>GACTTCGCAACAGTCAGAAAGGTCCTGAGCATGCCGCAGGTCAACATCGTCAAGAA<br>GACAGAAGTCCAGACAGGAGGAT-<br>TCAGCAAGGAAAGCATCCTGCCGAAGAGAAACAGCGACAAGCTGATCGCAAGAAAGAAGGACTGGGACCCG<br>AAGAAGTACGGAGGATTCGACAGCCCGACAGTCGCATA-<br>CAGCGTCCTGGTCGTCGCAAAGGTCGAAAAGGGAAAGAGCAAGAAGCTGAAGAGCG<br>TCAAGGAACTGCTGGGAATCACAATCATGGAAAGAAGCAGCTTCGAAAAGAACCC-<br>GATCGACTTCCTGGAAGCAAAGGGATACAAGGAAGTCAA<br>GAAGGACCTGATCATCAAGCTGCCGAAGTACAGCCTGTTCGAACTGGAAAACG-<br>GAAGAAAGAGAATGCTGGCAAGCGCAGGAGAACTGCAGAAG<br>GGAAACGAACTGGCACTGCCGAGCAAGTACGTCAACTTCCTGTACCTGGCAAGCCAC-<br>TACGAAAAGCTGAAGGGAAGCCCGGAAGACAACGAAC<br>AGAAGCAGCTGTTCGTCGAACAGCACAAGCACTACCTGGACGAAATCATCGAACA-<br>GATCAGCGAATTCAGCAAGAGAGTCATCCTGGCAGACGC<br>AAACCTGGACAAGGTCCTGAGCGCATACAACAAGCACAGAGACAAGCC-<br>GATCAGAGAACAGGCAGAAAACATCATCCACCTGTTCACACTGACA<br>AACCTGGGAGCACCGGCAGCATTCAAGTACTTCGACACAACAATCGACGAAAGAGATA-<br>CACAAGCACAAAGGAAGTCCTGGACGCAACACTGA<br>TCCACCAGAGCATCACAGGACTGTACGAAACAAGAATCGACCTGAGCCAGCTGGGAGGA-<br>GACGGAGGAGGAAGCGCAGCAGCAAAGAGAAAGTA<br>CTTCGCAGCATAG | |
| Open<br>reading<br>frame<br>for<br>Cas9<br>with<br>NLS10,<br>with<br>start<br>and<br>stop<br>codons | ATGGACAAGAAGTACAGCATCGGACTGGACATCGGAACAAACAGCGTCGGATGGGCAGT-<br>CATCACAGACGAATACAAGGTCCCGAGCAAGAAGT<br>TCAAGGTCCTGGGAAACACAGACAGACACAGCATCAAGAAGAACCTGATCG-<br>GAGCACTGCTGTTCGACAGCGGAGAAAACAGCAGAAGCAACAAG<br>ACTGAAGAGAACAGCAAGAAGAAGATACACAAGAAGAAAGAACAGAATCTGC-<br>TACCTGCAGGAAATCTTCAGCAACGAAATGGCAAAGGTCGAC<br>GACAGCTTCTTCCACAGACTGGAAGAAAGCTTCCTGGTCGAAGAA-<br>GACAAGAAGCACGAAAGACACCCGATCTTCGGAAACATCGTCGACGAAG<br>TCGCATACCACGAAAAGTACCCGCAACAATCTACCACCT-<br>GAGAAAGAAGCTGGTCGACAGCACAGACAAGGCAGACCTGAGACTGATCTACCTGGC<br>ACTGGCACACATGATCAAGTTCAGAGGACACTTCCTGATCGAAGGAGACCT-<br>GAACCCGGACAACAGCGACGTCGACAAGCTGTTCATCCAGCTG<br>GTCCAGACATACAACCAGCTGTTCGAAGAAAACCCGATCAACGCAAGCG-<br>GAGTCGACGCAAAGGCAATCCTGAGCGCAAGACTGAGCAAGAGCA<br>GAAGACTGGAAAACCTGATCGCACAGCTGCCGGGAGAAAAGAAGAACGGACTGTTCG-<br>GAAACCTGATCGCACTGAGCCTGGGACTGACACCGAA<br>CTTCAAGAGCAACTTCGACCTGGCAGAAGACGCAAAGCTGCAGCTGAGCAAGGACACAT-<br>ACGACGACGACCTGGACAACCTGCTGGCACAGATC<br>GGGAGACCAGTACGCAGACCTGTTCCTGGCAGCAAAGAACCTGAGCGACGCAATCCTGCT-<br>GAGCGACATCCTGAGAGTCAACACAGAAATCACAA<br>AGGCACCGCTGAGCGCAAGCATGATCAAGAGATACGACGAACAC-<br>CACCAGGACCTGACACTGCTGAAGGCACTGGTCAGACAGCAGCTGCCGGA<br>AAAGTACAAGGAAATCTTCTTCGACCAGAGCAAGAACGGATACGCAGGATACATCGACG-<br>GAGGAGCAAGCCAGGAAGAATTCTACAAGTTCATC<br>AAGCCGATCCTGGAAAAGATGGACGGAACAGAAGAACTGCTGGTCAAGCTGAACAGAGAA-<br>GACCTGCTGAGAAAGCAGAGAACATTCGACAACG<br>GAAGCATCCCGCACCAGATCCACCTGGGAGAACTGCACGCAATCCTGAGAAGACAGGAA-<br>GACTTCTACCCGTTCCTGAAGGACAACAGAGAAAA<br>GATCGAAAAGATCCTGACATTCAGAATCCCGTACTACGTCGGACCGCTGGCAAGAG-<br>GAAACAGCAGATTCGCATGGATGACAAGAAAGAGCGAA<br>GAAACAATCACACCGTGGAACTTCGAAGAAGTCGTCGACAAGG-<br>GAGCAAGCGCACAGAGCTTCATCGAAAGAATGACAAACTTCGACAAGAACC<br>TGCCGAACGAAAAGGTCCTGCCGAAGCACAGCCTGCTGTACGAATACTTCACAGTCTA-<br>CAACGAACTGACAAAGGTCAAGTACGTCACAGAAGG<br>AATGAGAAAGCCGGCATTCCTGAGCGGAGAACAGAAGAAGGCAATCGTCGACCTGCTGTT-<br>CAAGACAAACAGAAAGGTCACAGTCAAGCAGCTG<br>AAGGAAGACTACTTCAAGAAGATCGAATGCTTCGACAGCGTCGAAATCAGCGGAGTCGAA-<br>GACAGATTCAACGCAAGCCTGGGAACATACCACG<br>ACCTGCTGAAGATCATCAAGGACAAGGACTTCCTGGACAACGAAGAAAACGAAGA-<br>CATCCTGGAAGACATCGTCCTGACACTGACACTGTTCGA<br>AGACAGAGAAATGATCGAAGAAAGACTGAAGACATACGCACACCTGTTCGACGACAAGGT-<br>CATGAAGCAGCTGAAGAGAAGAAGATACAGGA<br>TGGGGAAGACTGAGCAGAAAGCTGATCAACGGAATCAGAGACAAGCAGAGCGGAAA-<br>GACAATCCTGGACTTCCTGAAGAGCGACGGATTCGCAA | 139 |

Sequence Table

The following sequence table provides a listing of sequences disclosed herein. It is understood that if a DNA sequence (comprising Ts) is referenced with respect to an RNA, then Ts should be replaced with Us(which may be modified or unmodified depending on the context), and vice versa.

| Description | Sequence | SEQ ID No. |
| --- | --- | --- |
| | ACAGAAACTTCATGCAGCTGATCCACGACGACAGCCTGACATTCAAGGAAGA-<br>CATCCAGAAGGCACAGGTCAGCGGACAGGGAGACAGCCTGCA<br>CGAACACATCGCAAACCTGGCAGGAAGCCCGGCAATCAAGAAGGGAATCCTGCAGACAGT-<br>CAAGGTCGTCGACGAACTGGTCAAGGTCATGGGA<br>AGACACAAGCCGGAAAACATCGTCATCGAAATGGCAAGAGAAAACCA-<br>GACAACACAGAAGGGACAGAAGAACAGCAGAGAAAGAATGAAGAGAA<br>TCGAAGAAGGAATCAAGGAACTGGGAAGCCAGATCCT-<br>GAAGGAACACCCGGTCGAAAACACACAGCTGCAGAACGAAAAGCTGTACCTGTACTA<br>CCTGCAGAACGGAAGAGACATGTACGTCGACCAGGAACTGGACATCAACAGACT-<br>GAGCGACTACGACGTCGACCACATCGTCCCGCAGAGCTTC<br>CTGAAGGACGACAGCATCGACAACAAGGTCCTGACAAGAAGCGACAAGAACAGAG-<br>GAAAGAGCGACAACGTCCCGAGCGAAGAAGTCGTCAAGA<br>AGATGAAGAACTACTGGAGACAGCTGCTGAACGCAAAGCTGAT-<br>CACACAGAGAAAGTTCGACAACCTGACAAAGGCAGAGAGAGGAGGACTGAG<br>CGAACTGGACAAGGCAGGATTCATCAAGAGACAGCTGGTCGAAACAAGACAGAT-<br>CACAAAGCACGTCGCACAGATCCTGGACAGCAGAATGAAC<br>ACAAAGTACGACGAAAACGACAAGCTGATCAGAGAAGTCAAGGTCATCACACT-<br>GAAGAGCAAGCTGGTCAGCGACTTCAGAAAGGACTTCCAGT<br>TCTACAAGGTCAGAGAAATCAACAACTACCACCACGCACACGACGCATACCT-<br>GAACGCAGTCGTCGGAACAGCACTGATCAAGAAGTACCCGAA<br>GCTGGAAAGCGAATTCGTCTACGGAGACTACAAGGTCTACGACGTCAGAAAGAT-<br>GATCGCAAAGAGCGAACAGGAAATCGGAAAGGCAACAGCA<br>AAGTACTTCTTCTACAGCAACATCATGAACTTCTTCAAGACAGAAAT-<br>CACACTGGCAAACGGAGAAATCAGAAAGAGACCGCTGATCGAAACAA<br>ACGGAGAAACAGGAGAAATCGTCTGGGACAAGGGAAGA-<br>GACTTCGCAACAGTCAGAAAGGTCCTGAGCATGCCGCAGGTCAACATCGTCAAGAA<br>GACAGAAGTCCAGACAGGAGGAT-<br>TCAGCAAGGAAAGCATCCTGCCGAAGAGAAACAGCGACAAGCTGATCGCAAGAAAGAAGGACTGGGACCCG<br>AAGAAGTACGGAGGATTCGACAGCCCGACAGTCGCATA-<br>CAGCGTCCTGGTCGTCGCAAAGGTCGAAAAGGGAAAGACCAAGAAGCTGAAGAGCG<br>TCAAGGAACTGCTGGGAATCACAATCATGGAAAGAAGCAGCTTCGAAAAGAACCC-<br>GATCGACTTCCTGGAAGCAAAGGGATACAAGGAAGTCAA<br>GAAGGACCTGATCATCAAGCTGCCGAAGTACAGCCTGTTCGAACTGGAAAACG-<br>GAAGAAAGAGAATGCTGGCAAGCGCAGGAGAACTGCAGAAG<br>GGAAACGAACTGGCACTGCCGAGCAAGTACGTCAACTTCCTGTACCTGGCAAGCCAC-<br>TACGAAAAGCTGAAGGGAAGCCCGGAAGACAACGAAC<br>AGAAGCAGCTGTTCGTCGAACAGCACAAGCACTACCTGGACGAAATCATCGAACA-<br>GATCAGCGAATTCAGCAAGAGAGTCATCCTGGCAGACGC<br>AAACCTGGACAAGGTCCTGAGCGCATACAACAAGCACAGAGACAAGCC-<br>GATCAGAGAACAGGCAGAAAACATCATCCACCTGTTCACACTGACA<br>AACCTGGGAGCACCGGCAGCATTCAAGTACTTCGACACAACAATCGACAGAAAGAGATA-<br>CACAAGCACAAAGGAAGTCCTGGACGCAACACTGA<br>TCCACCAGAGCATCACAGGACTGTACGAAACAAGAATCGACCTGAGCCAGCTGGGAGGA-<br>GACGGAGGAGGAAGCAGAGCAGCAAAGAGAAAGGC<br>ATTCGCAGCATAG | |
| Open reading frame for Cas9 with NLS11, with start and stop codons | ATGGACAAGAAGTACAGCATCGGACTGGACATCGGAACAAACAGCGTCGGATGGGCAGT-<br>CATCACAGACGAATACAAGGTCCCGAGCAAGAAGT<br>TCAAGGTCCTGGGAAACACAGACAGACACAGCATCAAGAAGAACCTGATCG-<br>GAGCACTGCTGTTCGACAGCGGAGAAACAGCAGAAGCAACAAG<br>ACTGAAGAGAACAGCAAGAAGAAGATACACAAGAAGAAAGACAGAATCTGC-<br>TACCTGCAGGAAATCTTCAGCAACGAAATGGCAAAGGTCGAC<br>GACAGCTTCTTCCACAGACTGGAAGAAAGCTTCCTGGTCGAAGAA-<br>GACAAGAAGCACGAAAGACACCCGATCTTCGGAAACATCGTCGACGAAG<br>TCGCATACCACGAAAAGTACCCGACAATCTACCACCT-<br>GAGAAAGAAGCTGGTCGACAGCACAGACAAGGCAGACCTGAGACTGATCTACCTGGC<br>ACTGGCACACATGATCAAGTTCAGAGGACACTTCCTGATCGAAGGAGACCT-<br>GAACCCGGACAACAGCGACGTCGACAAGCTGTTCATCCAGCTG<br>GTCCAGACATACAACCAGCTGTTCGAAGAAAACCCGATCAACGCAAGCG-<br>GAGTCGACGCAAAGGCAATCCTGAGCGCAAGACTGAGCAAGAGCA<br>GAAGACTGGAAAACCTGATCGCACAGCTGCCGGGAGAAAAGAAGAACGGACTGTTCG-<br>GAAACCTGATCGCACTGAGCCTGGGACTGACACCGAA<br>CTTCAAGAGCAACTTCGACCTGGCAGAAGACGCAAAGCTGCAGCTGAGCAAGGACACAT-<br>ACGACGACGACCTGGACAACCTGCTGGCACAGATC<br>GGAGACCAGTACGCAGACCTGTTCCTGGCAGCAAAGAACCTGAGCGACGCAATCCTGCT-<br>GAGCGACATCCTGAGAGTCAACACAGAAATCACAA<br>AGGCACCGCTGAGCGCAAGCATGATCAAGAGATACGACGAACAC-<br>CACCAGGACCTGACACTGCTGAAGGCACTGGTCAGACAGCAGCTGCCGGA<br>AAAGTACAAGGAAATCTTCTTCGACCAGAGCAAGAACGGATACGCAGGATACATCGACG-<br>GAGGAGCAAGCCAGGAAGAATTCTACAAGTTCATC<br>AAGCCGATCCTGGAAAAGATGGACGGAACAGAAGAACTGCTGGTCAAGCTGAACAGAGAA-<br>GACCTGCTGAGAAAGCAGAGAACATTCGACAACG<br>GAAGCATCCCGCACCAGATCCACCTGGGAGAACTGCACGCAATCCTGAGAAGACAGGAA-<br>GACTTCTACCCGTTCCTGAAGGACAACAGAGAAAA<br>GATCGAAAAGATCCTGACATTCAGAATCCCGTACTACGTCGGACCGCTGGCAAGAG-<br>GAAACAGCAGATTCGCATGGATGACAAGAAAGAGCGAA | 140 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | GAAACAATCACACCGTGGAACTTCGAAGAAGTCGTCGACAAGG-<br>GAGCAAGCGCACAGAGCTTCATCGAAAGAATGACAAACTTCGACAAGAACC<br>TGCCGAACGAAAAGGTCCTGCCGAAGCACAGCCTGCTGTACGAATACTTCACAGTCTA-<br>CAACGAACTGACAAAGGTCAAGTACGTCACAGAAGG<br>AATGAGAAAGCCGGCATTCCTGAGCGGAGAACAGAAGAAGGCAATCGTCGACCTGCTGTT-<br>CAAGACAAACAGAAAGGTCACAGTCAAGCAGCTG<br>AAGGAAGACTACTTCAAGAAGATCGAATGCTTCGACAGCGTCGAAATCAGCGGAGTCGAA-<br>GACAGATTCAACGCAAGCCTGGGAACATACCACG<br>ACCTGCTGAAGATCATCAAGGACAAGGACTTCCTGGACAACGAAGAAAACGAAGA-<br>CATCCTGGAAGACATCGTCCTGACACTGACACTGTTCGA<br>AGACAGAGAAATGATCGAAGAAAGACTGAAGACATACGCACACCTGTTCGACGACAAGGT-<br>CATGAAGCAGCTGAAGAGAAGAAGATACACAGGA<br>TGGGGAAGACTGAGCAGAAAGCTGATCAACGGAATCAGAGACAAGCAGAGCGGAAA-<br>GACAATCCTGGACTTCCTGAAGACGACGGATTCGCAA<br>ACAGAAACTTCATGCAGCTGATCCACGACGACAGCCTGACATTCAAGGAAGA-<br>CATCCAGAAGGCACAGGTCAGCGGACAGGGAGACAGCCTGCA<br>CGAACACATCGCAAACCTGGCAGGAAGCCCGGCAATCAAGAAGGGAATCCTGCAGACAGT-<br>CAAGGTCGTCGACGAACTGGTCAAGGTCATGGGA<br>AGACACAAGCCGGAAAACATCGTCATCGAAATGGCAAGAGAAAACCA-<br>GACAACACAGAAGGGACAGAAGAACAGCAGAGAAAGAATGAAGAGAA<br>TCGAAGAAGGAATCAAGGAACTGGGAAGCCAGATCCT-<br>GAAGGAACACCCGGTCGAAAACACACAGCTGCAGAACGAAAAGCTGTACCTGTACTA<br>CCTGCAGAACGGAAGAGACATGTACGTCGACCAGGAACTGGACATCAACAGACT-<br>GAGCGACTACGACGTCGACCACATCGTCCCGCAGAGCTTC<br>CTGAAGGACGACAGCATCGACAACAAGGTCCTGACAAGAAGCGACAAGAACAGAG-<br>GAAAGAGCGACAACGTCCCGAGCGAAGAAGTCGTCAAGA<br>AGATGAAGAACTACTGGAGACAGCTGCTGAACGCAAAGCTGAT-<br>CACACAGAGAAAGTTCGACAACCTGACAAAGGCAGAGAGAGGAGGACTGAG<br>CGAACTGGACAAGGCAGGATTCATCAAGAGACAGCTGGTCGAAACAAGACAGAT-<br>CACAAAGCACGTCGCACAGATCCTGGACAGCAGAATGAAC<br>ACAAAGTACGACGAAAACGACAAGCTGATCAGAGAAGTCAAGGTCATCACACT-<br>GAAGAGCAAGCTGGTCAGCGACTTCAGAAAGGACTTCCAGT<br>TCTACAAGGTCAGAGAAATCAACAACTACCACCACGCACACGACGCATACCT-<br>GAACGCAGTCGTCGGAACAGCACTGATCAAGAAGTACCCGAA<br>GCTGGAAAGCGAATTCGTCTACGGAGACTACAAGGTCTACGACGTCAGAAAGAT-<br>GATCGCAAAGAGCGAACAGGAAATCGGAAAGGCAACAGCA<br>AAGTACTTCTTCTACAGCAACATCATGAACTTCTTCAAGACAGAAAT-<br>CACACTGGCAAACGGAGAAATCAGAAAGAGACCGCTGATCGAAACAA<br>ACGGAGAAACAGGAGAAATCGTCTGGGACAAGGGAAGA-<br>GACTTCGCAACAGTCAGAAAGGTCCTGAGCATGCCGCAGGTCAACATCGTCAAGAA<br>GACAGAAGTCCAGACAGGAGGAT-<br>TCAGCAAGGAAAGCATCCTGCCGAAGAGAAACAGCGACAAGCTGATCGCAAGAAAGAAGGACTGGGACCCG<br>AAGAAGTACGGAGGATTCGACAGCCCGACAGTCGCATA-<br>CAGCGTCCTGGTCGTCGCAAAGGTCGAAAAGGGAAAGAGCAAGAAGCTGAAGAGCG<br>TCAAGGAACTGCTGGGAATCACAATCATGGAAAGAAGCAGCTTCGAAAAGAACCC-<br>GATCGACTTCCTGGAAGCAAAGGGATACAAGGAAGTCAA<br>GAAGGACCTGATCATCAAGCTGCCGAAGTACAGCCTGTTCGAACTGGAAAACG-<br>GAAGAAAGAGAATGCTGGCAAGCGCAGGAGAACTGCAGAAG<br>GGAAACGAACTGGCACTGCCGAGCAAGTACGTCAACTTCCTGTACCTGGCAAGCCAC-<br>TACGAAAAGCTGAAGGGAAGCCCGGAAGACAACGAAC<br>AGAAGCAGCTGTTCGTCGAACAGCACAAGCACTACCTGGACGAAATCATCGAACA-<br>GATCAGCGAATTCAGCAAGAGAGTCATCCTGGCAGACGC<br>AAACCTGGACAAGGTCCTGAGCGCATACAACAAGCACAGAGACAAGCC-<br>GATCAGAGAACAGGCAGAAAACATCATCCACCTGTTCACACTGACA<br>AACCTGGGAGCACCGGCAGCATTCAAGTACTTCGACACAACAATCGACAGAAAGAGATA-<br>CACAAGCACAAAGGAAGTCCTGGACGCAACACTGA<br>TCCACCAGAGCATCACAGGACTGTACGAAACAAGAATCGACCTGAGCCAGCTGGGAGGA-<br>GACGGAGGAGGAAGCAGAGCAGCAAAGAGAAAGTA<br>CTTCGCAGTCTAG | |
| Cas9<br>ORF<br>using<br>codons<br>with<br>gener-<br>ally<br>high | CCTAAGAAAAAGCGGAAGGTCGACGGGGATAAGAAGTACTCAATCGGGCTGGATATCG-<br>GAACTAATTCCGTGGGTTGGGCAGTGATCACGGATG<br>AATACAAAGTGCCGTCCAAGAAGTTCAAGGTCCTGGGGAACACCGATAGACACAGCAT-<br>CAAGAAAAATCTCATCGGAGCCCTGCTGTTTGACTC<br>CGGCGAAACCGCAGAAGCGACCCGGCTCAAACGTACCGCGAGGCGACGCTACACCCGGCG-<br>GAAGAATCGCATCTGCTATCTGCAAGAGATCTTT<br>TCGAACGAAATGGCAAAGGTCGACGACAGCTTCTTCCACCGCCTG-<br>GAAGAATCTTTCCTGGTGGAGGAGGACAAGAAGCATGAACGGCATCCTA<br>TCTTTTGGAAACATCGTCGACGAAGTGGCGTACCACGAAAAGTACCCGACCATCTAC-<br>CATCTGCGGAAGAAGTTGGTTGACTCAACTGACAAGGC<br>CGACCTCAGATTGATCTACTTGGCCCTCGCCCATATGATCAAATTCCGCGGACACTTCCT-<br>GATCGAAGGCGATCTGAACCCTGATAACTCCGAC<br>GTGGATAAGCTTTTCATTCAACTGGTGCAGACCTACAACCAACTGTTCGAAGAAAACC-<br>CAATCAATGCTAGCGGCGTCGATGCCAAGGCCATCC<br>TGTCCGCCCGGCTGTCGAAGTCGCGGCGCCTCGAAACCTGATCGCACAGCTGCCGG-<br>GAGAGAAAAAGAACGGACTTTTCGGCAACTTGATCGC | 141 |

| Description | Sequence | SEQ ID No. |
|---|---|---|
| expression in humans (no start or stop codons; suitable for inclusion in fusion protein coding sequence) start | TCTCTCACTGGGACTCACTCCCAATTTCAAGTCCAAT-TTTGACCTGGCCGAGGACGCGAAGCTGCAACTCTCAAAGGACACCTACGACGACGAC TTGGACAATTTGCTGGCACAAATTGGCGATCAGTACGCG-GATCTGTTCCTTGCCGCTAAGAACCTTTCGGACGCAATCTTGCTGTCCGATATCC TGCGCGTGAACACCGAAATAACCAAAGCGCCGCTTAGCGCCTCGATGAT-TAAGCGGTACGACGAGCATCACCAGGATCTCACGCTGCTCAAAGC GCTCGTGAGACAGCAACTGCCTGAAAAGTACAAGGAGATCTTCTTCGACCAGTC-CAAGAATGGGTACGCAGGGTACATCGATGGAGGCGCTAGC CAGGAAGAGTTCTATAAGTTCATCAAGCCAATCCTGGAAAAGATGGACG-GAACCGAAGAACTGCTGGTCAAGCTGAACAGGGAGGATCTGCTCC GGAAACAGAGAACCTTTGACAACGGATCCATTCCCCACCAGATCCATCTGGGT-GAGCTGCACGCCATCTTGCGGCGCCAGGAGGACTTTTACCC ATTCCTCAAGGACAACCGGGAAAAGATCGAGAAAATTCTGACGTTCCGCATCCCGTAT-TACGTGGGCCCACTGGCGCGCGGCAATTCGCGCTTC GCGTGGATGACTAGAAAATCAGAGGAAACCATCACTCCTTGGAATTTCGAGGAAGTTGTG-GATAAGGGAGCTTCGGCACAAAGCTTCATCGAAC GAATGACCAACTTCGACAAGAATCTCC-CAAACGAGAAGGTGCTTCCTAAGCACAGCCTCCTTTACGAATACTTCACTGTCTACAACGAACTGAC TAAAGTGAAATACGTTACTGAAGGAATGAGGAAGCCGGCCTTTCTGTCCG-GAGAACAGAAGAAAGCAATTGTCGATCTGCTGTTCAAGACCAAC CGCAAGGTGACCGTCAAGCAGCTTAAAGAGGACTACTTCAAGAA-GATCGAGTGTTTCGACTCAGTGGAAATCAGCGGGGTGGAGGACAGATTCA ACGCTTCGCTGGGAACCTATCATGATCTCCTGAAGATCAT-CAAGGACAAGGACTTCCTTGACAACGAGGAGAACGAGGACATCCTGGAAGATAT CGTCCTGACCTTGACCCTTTTCGAGGATCGCGAGATGATCGAGGAGAGGCTTAAGACC-TACGCTCATCTCTTCGACGATAAGGTCATGAAACAA CTCAAGCGCCGCCGGTACACTGGTTGGGGCCGCCTCTCCCGCAAGCTGATCAACGGTAT-TCGCGATAAACAGAGCGGTAAAACTATCCTGGATT TCCTCAAATCGGATGGCTTCGCTAATCGTAACTTCATGCAATTGATC-CACGACGACAGCCTGACCTTTAAGGAGGACATCCAAAAAGCACAAGT GTCCGGACAGGGAGACTCACTCCATGAACACATCGCGAATCTGGCCGGTTCGCCGGCGAT-TAAGAAGGGAATTCTGCAAACTGTGAAGGTGGTC GACGAGCTGGTGAAGGTCATGGGACGGCACAAACCGGAGAATATCGTGATT-GAAATGGCCCGAGAAAACCAGACTACCCAGAAGGGCCAGAAAA ACTCCCGCGAAAGGATGAAGCGGATCGAAGAAGGGAATCAAGGAGCTGGGCAGCCA-GATCCTGAAAGAGCACCCGGTGGAAAACACGCAGCTGCA GAACGAGAAGCTCTACCTGTACTATTTGCAAAATGGACGGGACATGTACGTGGAC-CAAGAGCTGGACATCAATCGGTTGTCTGATTACGACGTG GACCACATCGTTCCACAGTCCTTTCTGAAGGATGACTCGATCGA-TAACAAGGTGTTGACTCGCAGCGACAAGAACAGAGGGAAGTCAGATAATG TGCCATCGGAGGAGGTCGTGAAGAAGATGAAGAATTACTGGCGGCAGCTCCT-GAATGCGAAGCTGATTACCCAGAGAAAGTTTGACAATCTCAC TAAAGCCGAGCGCGGCGGACTCTCAGAGCTGGATAAGGCTGGATTCAT-CAAACGGCAGCTGGTCGAGACTCGGCAGATTACCAAGCACGTGGCG CAGATCTTGGACTCCCGCATGAACACTAAATACGACGAGAACGATAAGCTCATCCGG-GAAGTGAAGGTGATTACCCTGAAAAGCAAACTTGTGT CGGACTTTCGGAAGGACTTTCAGTTTTACAAAGTGAGAGAAATCAACAACTACCAT-CACGCGCATGACGCATACCTCAACGCTGTGGTCGGTAC CGCCCTGATCAAAAAGTACCCTAAACTTGAATCGGAGTTTGTGTACGGAGACTA-CAAGGTCTACGACGTGAGGAAGATGATAGCCAAGTCCGAA CAGGAAATCGGGAAAGCAACTGCGAAATACTTCTTTTTACTCAAACATCATGAACTTTTT-CAAGACTGAAATTACGCTGGCCAATGAGAAATCA GGAAGAGGCCACTGATCGAAACTAACG-GAGAAACGGGCGAAATCGTGTGGGACAAGGGCAGGGACTTCGCAACTGTTCGCAAAGTGCTCTCTAT GCCGCAAGTCAATATTGTGAAGAAAACCGAAGTGCAAACCGGCGGATTTTCAAAGGAATC-GATCCTCCCAAAGAGAAATAGCGACAAGCTCATT GCACGCAAGAAAGACTGGGACCCGAAGAAGTACGGAGGATTCGATTCGCCGACTGTCG-CATACTCCGTCCTCGTGGTGGCCAAGGTGGAGAAGG GAAAGAGCAAAAAGCTCAAATCCGTCAAAGAGCTGCTGGGGATTACCATCATGGAAC-GATCCTCGTTCGAGAAGAACCCGATTGATTTCCTCGA GGCGAAGGGTTACAAGGAGGTGAAGAAGGATCTGATCATCAAACTCCCCAAGTACT-CACTGTTCGAACTGGAAAATGGTCGGAAGCGCATGCTG GCTTCGGCCGGAGAACTCCAAAAAGGAAATGAGCTGGCCTTGCCTAGCAAGTACGT-CAACTTCCTCTATCTTGCTTCGCACTACGAAAAACTCA AAGGGTCACCGGAAGATAACGAACAGAAGCAGCTTTTCGTGGAGCAGCACAAGCAT-TATCTGGATGAAATCATCGAACAAATCTCCGAGTTTTC AAAGCGCGTGATCCTCGCCGACGCCAACCTCGACAAAGTCCTGTCGGCCTA-CAATAAGCATAGAGATAAGCCGATCAGAGAACAGGCCGAGAAC ATTATCCACTTGTTCACCCTGACTAACCTGGGAGCCCCAGCCGCCTTCAAGTACTTCGA-TACTACTATCGATCGCAAAAGATACACGTCCACCA AGGAAGTTCTGGACGCGACCCTGATCCACCAAAGCATCACTGGACTCTACGAAACTAGGATCGATCTGTCGCAGCTGGGTGGCGAT | |
| Cas9 ORF | GACAAGAAGTACTCTATCGGTTTGGACATCGGTACCAACTCTGTCGGTTGGGCCGTCAT-CACCGACGAATACAAGGTCCCATCTAAGAAGTTCA AGGTCTTGGGTAACACCGACAGACACTCTATCAAGAAGAACTT-GATCGGTGCCTTGTTGTTCGACTCTGGTGAAACCGCCGAAGCCACCAGATT | 142 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| using long half life codons of Table 4 (no start or stop codons; suitable for inclusion in fusion protein coding sequence) | GAAGAGAACCGCCAGAAGAAGATACACCAGAAGAAAGAACAGAATCTGC-TACTTGCAAGAAATCTTCTCTAACGAAATGGCCAAGGTCGACGACTCTTTCTTCCACAGATTGGAAGAATCTTTCTTGGTCGAAGAAGACAAGAAGCACGAAAGACACCCAATCTTCGGTAACATCGTCGACGAAGTCGCCTACCACGAAAAGTACCCAACCATCTACCACTTGAGAAAGAAGTTGGTCGACTCTACCGACAAGGCCGACTTGAGATTGATCTACTTGGCCTTGGCCCACATGATCAAGTTCAGAGGTCACTTCTTGATCGAAGGTGACTTGAACCCAGACAACTCTGACGTCGACAAGTTGTTCATCCAATTGGTCCAAACCTACAACCAATTGTTCGAAGAAAACCCAATCAACGCCTCTGGTGTCGACGCCAAGGCCATCTTGTCTGCCAGATTGTCTAAGAGCAGAAGATTGGAAAACTTGATCGCCCAATTGCCAGGTGAAAAGAAGAACGGTTTGTTCGGTAACTTGATCGCCTTGTCTTTGGGTTTGACCCCAAACTTCAAGTCTAACTTCGACTTGGCCGAAGACGCCAAGTTGCAATTGTCTAAGGACACCTACGACGACGACTTGGACAACTTGTTGGCCCAAATCGGTGACCAATACGCCGACTTGTTCTTGGCCGCCAAGAACTTGTCTGACGCCATCTTGTTGTCTGACATCTTGAGAGTCAACACCGAAATCACCAAGGCCCCATTGTCTGCCTCTATGATCAAGAGATACGACGAACACCACCAAGACTTGACCTTGTTGAAGGCCTTGGTCAGACAACAATTGCCAGAAAAGTACAAGGAAATCTTCTTCGACCAATCTAAGAACGGTTACGCCGGTTACATCGACGGTGGTGCCTCTCAAGAAGAATTCTACAAGTTCATCAAGCCAATCTTGGAAAAGATGGACGGTACCGAAGAATTGTTGGTCAAGTTGAACAGAGAAGACTTGTTGAGAAAGCAAAGAACCTTCGACAACGGTTCTATCCCACACCAAATCCACTTGGGTGAATTGCACGCCATCTTGAGAAGACAAGAAGACTTCTACCCATTCTTGAAGGACAACAGAGAAAAGATCGAAAAGATCTTGACCTTCAGAATCCCATACTACGTCGGTCCATTGGCCAGAGGTAACAGCAGATTCGCCTGGATGACCAGAAAGTCTGAAGAAACCATCACCCCATGGAACTTCGAAGAAGTCGTCGACAAGGGTGCCTCTCCCAATCTTTCATCGAAAGAATGACCAACTTCGACAAGAACTTGCCAAACGAAAAGGTCTTGCCAAAGCACTCTTTGTTGTACGAATACTTCACCGTCTACAACGAATTGACCAAGGTCAAGTACGTCACCGAAGGTATGAGAAAGCCAGCCTTCTTGTCTGGTGAACAAAAGAAGGCCATCGTCGACTTGTTGTTCAAGACCAACAGAAAGGTCACCGTCAAGCAATTGAAGGAAGACTACTTCAAGAAGATCGAATGCTTCGACTCTGTCGAAATCTCTGGTGTCGAAGACAGATTCAACGCCTCTTTGGGTACCTACCACGACTTGTTGAAGATCATCAAGGACAAGGACTTCTTGGACAACGAAGAAAACGAAGACATCTTGGAAGACATCGTCTTGACCTTGACCTTGTTCGAAGACAGAGAAATGATCGAAGAAAGATTGAAGACCTACGCCCACTTGTTCGACGACAAGGTCATGAAGCAATTGAAGAGAAGAAGATACACCGGTTGGGGTAGATTGAGCAGAAAGTTGATCAACGGTATCAGAGACAAGCAATCTGGTAAGACCATCTTGGACTTCTTGAAGTCTGACGGTTTCGCCAACAGAAACTTCATGCAATTGATCCACGACGACTCTTTGACCTTCAAGGAAGACATCCAAAAGGCCCAAGTCTCTGGTCAAGGTGACTCTTTGCACGAACACATCGCCAACTTGGCCGGTTCTCCAGCCATCAAGAAGGGTATCTTGCAAACCGTCAAGGTCGTCGACGAATTGGTCAAGGTCATGGGTAGACACAAGCCAGAAAACATCGTCATCGAAATGGCCAGAGAAAACCAAACCACCCAAAAGGGTCAAAAGAACAGCAGAGAAAGAATGAAGAGAATCGAAGAAGGTATCAAGGAATTGGGTTCTCAAATCTTGAAGGAACACCCAGTCGAAAACACCCAATTGCAAAACGAAAAGTTGTACTTGTACTACTTGCAAAACGGTAGAGACATGTACGTCGACCAAGAATTGGACATCAACAGATTGTCTGACTACGACGTCGACCACATCGTCCCACAATCTTTCTTGAAGGACGACTCTATCGACAACAAGGTCTTGACCAGATCTGACAAGAACAGAGGTAAGTCTGACAACGTCCCATCTGAAGAAGTCGTCAAGAAGATGAAGAACTACTGGAGACAATTGTTGAACGCCAAGTTGATCACCCAAAGAAAGTTCGACAACTTGACCAAGGCCGAAAGAGGTGGTTTGTCTGAATTGGACAAGGCCGGTTTCATCAAGAGACAATTGGTCGAAACCAGACAAATCACCAAGCACGTCGCCCAAATCTTGGACAGCAGAATGAACACCAAGTACGACGAAAACGACAAGTTGATCAGAGAAGTCAAGGTCATCACCTTGAAGTCTAAGTTGGTCTCTGACTTCAGAAAGGACTTCCAATTCTACAAGGTCAGAGAAATCAACAACTACCACCACGCCCACGACGCCTACTTGAACGCCGTCGTCGGTACCGCCTTGATCAAGAAGTACCCAAAGTTGGAATCTGAATTCGTCTACGGTGACTACAAGGTCTACGACGTCAGAAAGATGATCGCCAAGTCTGAACAAGAAATCGGTAAGGCCACCGCCAAGTACTTCTTCTACTCTAACATCATGAACTTCTTCAAGACCGAAATCACCTTGGCCAACGGTGAAATCAGAAAGAGACCATTGATCGAAACCAACGGTGAAACCGGTGAAATCGTCTGGGACAAGGGTAGAGACTTCGCCACCGTCAGAAAGGTCTTGTCTATGCCACAAGTCAACATCGTCAAGAAGACCGAAGTCCAAACCGGTGGTTTCTCTAAGGAATCTATCTTGCCAAAGAGAAACTCTGACAAGTTGATCGCCAGAAAGAAGGACTGGGACCCAAAGAAGTACGGTGGTTTCGACTCTCCAACCGTCGCCTACTCTGTCTTGGTCGTCGCCAAGGTCGAAAAGGGTAAGTCTAAGAAGTTGAAGTCTGTCAAGGAATTGTTGGGTATCACCATCATGGAAAGATCTTCTTTCGAAAAGAACCCAATCGACTTCTTGGAAGCCAAGGGTTACAAGGAAGTCAAGAAGGACTTGATCATCAAGTTGCCAAAGTACTCTTTGTTCGAATTGGAAAACGGTAGAAAGAGAATGTTGGCCTCTGCCGGTGAATTGCAAAAGGGTAACGAATTGGCCTTGCCATCTAAGTACGTCAACTTCTTGTACTTGGCCTCTCACTACGAAAAGTTGAAGGGTTCTCCAGAAGACAACGAACAAA |  |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | AGCAATTGTTCGTCGAACAACACAAGCACTACTTGGACGAAATCATCGAACAAATCTCT-GAATTCTCTAAGAGAGTCATCTTGGCCGACGCCAA CTTGGACAAGGTCTTGTCTGCCTACAACAAGCACAGAGACAAGC-CAATCAGAGAACAAGCCGAAAACATCATCCACTTGTTCACCTTGACCAAC TTGGGTGCCCCAGCCGCCTTCAAGTACTTCGACACCACCATCGACAGAAAGAGATA-CACCTCTACCAAGGAAGTCTTGGACGCCACCTTGATCC ACCAATCTATCACCGGTTTGTACGAAACCAGAATCGACTTGTCTCAAT-TGGGTGGTGACGGTGGTGGTTCTCCAAAGAAGAAGAGAAAGGTC | |
| Cas9 ORF using U rich codons of Table 4 (no start or stop codons; suit- able for in- clusion in fusion protein coding se- quence) | GATAAAAAATATTCTATTGGTTTAGATATTGGTACTAATTCTGTTGGTTGGGCTGTTAT-TACTGATGAATATAAAGTTCCTTCTAAAAAATTTA AAGTTTTAGGTAATACTGATCGTCATTCTATTAAAAAAAATTTAATTGGTGCTTTATTAT-TTGATTCTGGTGAAACTGCTGAAGCTACTCGTTT AAAACGTACTGCTCGTCGTCGTTATACTCGTCGTAAAAATCGTATTTGTTATTTA-CAAGAAATTTTTTCTAATGAAATGGCTAAAGTTGATGAT TCTTTTTTTCATCGTTTAGAAGAATCTTTTTTAGTTGAAGAAGATAAAAAACATGAACGT-CATCCTATTTTTGGTAATATTGTTGATGAAGTTG CTTATCATGAAAAATATCCTACTATTTATCATTTACGTAAAAAATTAGTTGATTCTACT-GATAAAGCTGATTTACGTTTAATTTATTTAGCTTTT AGCTCATATGATTAAATTTCGTGGTCATTTTTTAATTGAAGGTGATTTAAATCCTGA-TAATTCTGATGTTGATAAATTATTTATTCAATTAGTT CAAACTTATAATCAATTATTTGAAGAAAATCCTATTAATGCTTCTGGTGTT-GATGCTAAAGCTATTTTATCTGCTCGTTTATCTAAATCTCGTC GTTTAGAAAATTTAATTGCTCAATTACCTGGTGAAAAAAAAAATGGTTTATTTGGTAATT-TAATTGCTTTATCTTTAGGTTTAACTCCTAATTT TAAATCTAATTTTGATTTAGCTGAAGATGCTAAATTACAATTATCTAAAGATACTTAT-GATGATGATTTAGATAATTTATTAGCTCAAATTGGT GATCAATATGCTGATTTATTTTTAGCTGCTAAAAATTTATCTGATGCTATTTTATTATCT-GATATTTTACGTGTTAATACTGAAATTACTAAAG CTCCTTTATCTGCTTCTATGATTAAACGTTATGATGAACATCATCAAGATTTAACTTTAT-TAAAAGCTTTAGTTCGTCAACAATTACCTGAAAA ATATAAAGAAATTTTTTTTGATCAATCTAAAAATGGTTATGCTGGTTATATT-GATGGTGGTGCTTCTCAAGAAGAATTTTATAAATTTATTAAA CCTATTTTAGAAAAAATGGATGGTACTGAAGAATTATTAGTTAAATTAAATCGTGAAGAT-TTATTACGTAAACAACGTACTTTTGATAATGGTT CTATTCCTCATCAAATTCATTTAGGTGAATTACATGCTATTTTACGTCGTCAAGAAGAT-TTTTATCCTTTTTTAAAAGATAATCGTGAAAAAAT TGAAAAAATTTTAACTTTTCGTATTCCTTATTATGTTGGTCCTTTAGCTCGTGGTAAT-TCTCGTTTTGCTTGGATGACTCGTAAATCTGAAGAA ACTATTACTCCTTGGAATTTTGAAGAAGTTGTTGATAAAGGTGCTTCTGCTCAATCTTTT-ATTGAACGTATGACTAATTTTGATAAAAATTTAC CTAATGAAAAAGTTTTACCTAAACATTCTTTATTATATGAATATTTTACTGTTTATAAT-GAATTAACTAAAGTTAAATATGTTACTGAAGGTAT GCGTAAACCTGCTTTTTTATCTGGTGAACAAAAAAAGCTATTGTTGATTTATTATT-TAAAACTAATCGTAAAGTTACTGTTAAACAATTAAAA GAAGATTATTTAAAAAAATTGAATGTTTTGATTCTGTTGAAATTTCTGGTGTTGAA-GATCGTTTTAATGCTTCTTTAGGTACTTATCATGATT TATTAAAAATTATTAAAGATAAAGATTTTTTAGATAATGAAGAAAATGAAGATATTT-TAGAAGATATTGTTTTAACTTTAACTTTATTTGAAGA TCGTGAAATGATTGAAGAACGTTTAAAAACTTATGCTCATTTATTTGATGATAAAGTTAT-GAAACAATTAAAACGTCGTCGTTATACTGGTTGG GGTCGTTTATCTCGTAAATTAATTAATGGTATTCGTGATAAACAATCTGGTAAAACTAT-TTTAGATTTTTTAAAATCTGATGGTTTTGCTAATC GTAATTTTATGCAATTAATTCATGATGATTCTTTAACTTTTAAAGAAGATATT-CAAAAAGCTCAAGTTTCTGGTCAAGGTGATTCTTTACATGA ACATATTGCTAATTTAGCTGGTTCTCCTGCTATTAAAAAAGGTATTTTACAAACTGT-TAAAGTTGTTGATGAATTAGTTAAAGTTATGGGTCGT CATAAACCTGAAAATATTGTTATTGAAATGGCTCGTGAAAATCAAACTACTCAAAAAGGT-CAAAAAAATTCTCGTGAACGTATGAAACGTATTG AAGAAGGTATTAAAGAATTAGGTTCTCAAATTTTAAAAGAACATCCTGTTGAAAATACT-CAATTACAAAATGAAAAATTATATTTATATTATTT ACAAAATGGTCGTGATATGTATGTTGATCAAGAATTAGATATTAATCGTTTATCTGAT-TATGATGTTGATCATATTGTTCCTCAATCTTTTTA AAGATGATTCTATTGATAATAAAGTTTTAACTCGTTCTGATAAAAATCGTGGTAAATCT-GATAATGTTCCTTCTGAAGAAGTTGTTAAAAAAA TGAAAAATTATTGGCGTCAATTATTAAATGCTAAATTAATTACTCAACGTAAATTTGA-TAATTTAACTAAAGCTGAACGTGGTGGTTTATCTGA ATTAGATAAAGCTGGTTTTATTAAACGTCAATTAGTTGAAACTCGTCAAATTACTAAA-CATGTTGCTCAAATTTTAGATTCTCGTATGAATACT AAAATATGATGAAATGATAAATTAATTCGTGAAGTTAAAGTTATTACTT-TAAAATCTAAATTAGTTTCTGATTTTCGTAAAGATTTTCAATTTT ATAAAGTTCGTGAAATTAATAATTATCATCATGCTCATGATGCTTATT-TAAATGCTGTTGTTGGTACTGCTTTAATTAAAAAATATCCTAAATT AGAATCTGAATTTGTTTATGGTGATTATAAAGTTTATGATGTTCGTAAAATGAT-TGCTAAATCTGAACAAGAAATTGGTAAAGCTACTGCTAAA | 143 |

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | TATTTTTTTATTCTAATATTATGAATTTTTTTAAAACTGAAATTACTTTAGCTAATGGT-GAAATTCGTAAACGTCCTTTAATTGAAACTAATG<br>GTGAAACTGGTGAAATTGTTTGGGATAAAGGTCGTGATTTTGCTACTGTTCGTAAAGTTT-TATCTATGCCTCAAGTTAATATTGTTAAAAAAAC<br>TGAAGTTCAAACTGGTGGTTTTTCTAAAGAATCTATTTTACCTAAACGTAATTCTGA-TAAATTAATTGCTCGTAAAAAAGATTGGGATCCTAAA<br>AAATATGGTGGTTTTGATTCTCCTACTGTTGCTTATTCTGTTTTAGTTGTTGCTAAAGTT-GAAAAAGGTAAATCTAAAAAATTAAAATCTGTTA<br>AAGAATTATTAGGTATTACTATTATGGAACGTTCTTCTTTTGAAAAAAATCCTATTGAT-TTTTTAGAAGCTAAAGGTTATAAAGAAGTTAAAAA<br>AGATTTAATTATTAAATTACCTAAATATTCTTTATTTGAATT-AGAAAATGGTCGTAAACGTATGTTAGCTTCTGCTGGTGAATTACAAAAAGGT<br>AATGAATTAGCTTTACCTTCTAAATATGTTAATTTTTTATATTTAGCTTCTCATTAT-GAAAAATTAAAAGGTTCTCCTGAAGATAATGAACAAA<br>AACAATTATTTGTTGAACAACATAAACATTATTTAGATGAAATTATTGAACAAATTTCT-GAATTTTCTAAACGTGTTATTTTAGCTGATGCTAA<br>TTTAGATAAAGTTTTATCTGCTTATAATAAACATCGTGATAAACCTATTCGT-GAACAAGCTGAAAATATTATTCATTTATTTACTTTAACTAAT<br>TTAGGTGCTCCTGCTGCTTTTAAATATTTTGATACTACTATTGATCGTAAACGT-TATACTTCTACTAAAGAAGTTTTAGATGCTACTTTAATTC<br>ATCAATCTATTACTGGTTTATATGAAACTCGTATTGATTTATCTCAATTAGGTGGT-GATGGTGGTGGTTCTCCTAAAAAAAAACGTAAAGTT | |
| Cas9 ORF using low G codons of Table 4 (no start or stop codons; suitable for inclusion in fusion protein coding sequence) | GACAAAAAATACTCCATCGGCCTCGACATCGGCACCAACTCCGTCGGCTGGGCCGTCAT-CACCGACGAATACAAAGTCCCCTCCAAAAAATTCA<br>AAGTCCTCGGCAACACCGACAGACACTCCATCAAAAAAAACCT-CATCGGCGCCCTCCTCTTCGACTCCGGCGAAACCGCCGAAGCCACCAGACT<br>CAAAAGAACCGCCAGAAGAAGATACACCAGAAGAAAAAACAGAATCTGCTACCTC-CAAGAAATCTTCTCCAACGAAATGGCCAAAGTCGACGAC<br>TCCTTCTTCCACAGACTCGAAGAATCCTTCCTCGTCGAAGAAGCAAAAAACACGAAA-GACACCCCATCTTCGGCAACATCGTCGACGAAGTCG<br>CCTACCACGAAAAATACCCCACCATCTACCACCTCAGAAAAAAACTCGTCGACTC-CACCGACAAAGCCGACCTCAGACTCATCTACCTCGCCCT<br>CGCCCACATGATCAAATTCAGAGGCCACTTCCTCATCGAAGGCGACCT-CAACCCCGACAACTCCGACGTCGACAAACTCTTCATCCAACTCGTC<br>CAAACCTACAACCAACTCTTCGAAGAAAACCCCATCAACGCCTCCGGCGTCGACGC-CAAAGCCATCCTCTCCGCCAGACTCTCCAAATCCAGAA<br>GACTCGAAAACCTCATCGCC-CAACTCCCCGGCGAAAAAAAAACGGCCTCTTCGGCAACCTCATCGCCCTCTCCCTCGGCCTCACCCCCAACTT<br>CAAATCCAACTTCGACCTCGCCGAAGACGCCAAACTCCAACTCTCCAAAGACACC-TACGACGACGACCTCGACAACCTCCTCGCCCAAATCGGC<br>GACCAATACGCCGACCTCTTCCTCGCCGCCAAAAACCTCTCCGACGC-CATCCTCCTCTCCGACATCCTCAGAGTCAACACCGAAATCACCAAAG<br>CCCCCCTCTCCGCCTCCATGATCAAAAGATACGACGAACACCACCAAGACCT-CACCCTCCTCAAAGCCCTCGTCAGACAACAACTCCCCGAAAA<br>ATACAAAGAAATCTTCTTCGACCAATCCAAAAACGGCTACGCCGGCTA-CATCGACGCGGCGCCTCCCAAGAAGAATTCTACAAATTCATCAAA<br>CCCATCCTCGAAAAAATGGACGGCACCGAAGAACTCCTCGTCAAACTCAACAGAGAA-GACCTCCTCAGAAAACAAAGAACCTTCGACAACGGCT<br>CCATCCCCCACCAAATCCACCTCGGCGAACTCCACGCCATCCTCAGAAGACAAGAA-GACTTCTACCCCTTCCTCAAAGACAACAGAGAAAAAAT<br>CGAAAAAATCCTCACCTTCAGAATCCCCTAC-TACGTCGGCCCCCTCGCCAGAGGCAACTCCAGATTCGCCTGGATGACCAGAAAATCCGAAGAA<br>ACCATCACCCCCTGGAACTTCGAAGAAGTCGTCGACAAAGGCGCCTCCGCCCAATCCTT-CATCGAAAGAATGACCAACTTCGACAAAAACCTCC<br>CCAACGAAAAAGTCCTCCCCAAACACTCCCTCCTCTACGAATACTTCACCGTCTA-CAACGAACTCACCAAAGTCAAATACGTCACCGAAGGCAT<br>GAGAAAACCCGCCTTCCTCTCCGGCGAACAAAAAAAAGCCATCGTCGACCTCCTCTTT-CAAAACCAACAGAAAGTCACCGTCAAACAACTCAAA<br>GAAGACTACTTCAAAAAAATCGAATGCTTCGACTCCGTCGAAATCTCCGGCGTCGAA-GACAGATTCAACGCCTCCCTCGGCACCTACCACGACC<br>TCCTCAAAATCATCAAAGACAAAGACTTCCTCGACAACGAAGAAAACGAAGA-CATCCTCGAAGACATCGTCCTCACCCTCACCCTCTTCGAAGA<br>CAGAGAAATGATCGAAGAAAGACTCAAAACCTACGCCCACCTCTTCGACGACAAAGTCAT-GAAACAACTCAAAAGAAGAAGATACACCGGCTGG<br>GGCAGACTCTCCAGAAAACTCATCAACGGCATCAGAGACAAACAATCCGGCAAAAC-CATCCTCGACTTCCTCAAATCCGACGGCTTCGCCAACA<br>GAAACTTCATGCAACTCATCCACGACGACTCCCTCACCTTCAAAGAAGACATC-CAAAAAGCCCAAGTCTCCGGCAAGGCGACTCCCTCCACGA<br>ACACATCGCCAACCTCGCCGGCTCCCCCGCCATCAAAAAAGGCATCCTCCAAACCGT-CAAAGTCGTCGACGAACTCGTCAAAGTCATGGGCAGA<br>CACAAACCCGAAAACATCGTCATCGAAATGGCCAGAGAAAACCAAACCACCCAAAAGGC-CAAAAAAACTCCAGAGAAAGAATGAAAAGAATCG<br>AAGAAGGCATCAAAGAACTCGGCTCCCAAATCCTCAAAGAACACCCCGTCGAAAACACC-CAACTCCAAAACGAAAAACTCTACCTCTACTACCT | 144 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | CCAAAACGGCAGAGACATGTACGTCGACCAAGAACTCGACATCAACAGACTCTCCGAC-<br>TACGACGTCGACCACATCGTCCCCCAATCCTTCCTC<br>AAAGACGACTCCATCGACAACAAAGTCCTCACCA-<br>GATCCGACAAAAACAGAGGCAAATCCGACAACGTCCCCTCCGAAGAAGTCGTCAAAAAAA<br>TGAAAAACTACTGGAGACAACTCCTCAACGCCAAACTCATCACCCAAAGAAAAT-<br>TCGACAACCTCACCAAAGCCGAAAGAGGCGGCCTCTCCGA<br>ACTCGACAAAGCCGGCTTCATCAAAAGACAACTCGTCGAAACCAGACAAATCAC-<br>CAAACACGTCGCCCAAATCCTCGACTCCAGAATGAACACC<br>AAATACGACGAAAACGACAAACTCATCAGAGAAGTCAAAGTCATCACCCTCAAATC-<br>CAAACTCGTCTCCGACTTCAGAAAAGACTTCCAATTCT<br>ACAAAGTCAGAGAAATCAACAACTACCACCACGCCCACGACGCCTACCT-<br>CAACGCCGTCGTCGGCACCGCCCTCATCAAAAAATACCCCAAACT<br>CGAATCCGAATTCGTCTACGGCGACTACAAAGTCTACGACGTCAGAAAAATGATCGC-<br>CAAATCCGAACAAGAAATCGGCAAAGCCACCGCCAAA<br>TACTTCTTCTACTCCAACATCATGAACTTCTTCAAAACCGAAATCACCCTCGC-<br>CAACGGCGAAATCAGAAAAAGACCCCTCATCGAAACCAACG<br>GCGAAACCGGCGAAATCGTCTGGGACAAAGGCAGAGACTTCGC-<br>CACCGTCAGAAAAGTCCTCTCCATGCCCCAAGTCAACATCGTCAAAAAAAC<br>CGAAGTCCAAACCGGCGGCTTCTCCAAAGAATCCATCCTCCC-<br>CAAAAGAAACTCCGACAAACTCATCGCCAGAAAAAAAGACTGGGACCCCAAA<br>AAATACGGCGGCTTCGACTCCCCCACCGTCGCCTACTCCGTCCTCGTCGTCGC-<br>CAAAGTCGAAAAGGCAAATCCAAAAAACTCAAATCCGTCA<br>AAGAACTCCTCGGCATCACCATCATGGAAAGATCCTCCTTCGAAAAAACCC-<br>CATCGACTTCCTCGAAGCCAAAGGCTACAAAGAAGTCAAAAA<br>AGACCTCATCATCAAACTCCC-<br>CAAATACTCCCTCTTCGAACTCGAAAACGGCAGAAAAAGAATGCTCGCCTCCGCCGGCGAACTCCAAAAGGC<br>AACGAACTCGCCCTCCCCCTCCAAATACGTCAACTTCCTCTACCTCGCCTCCCAC-<br>TACGAAAAACTCAAAGGCTCCCCCGAAGACAACGAACAAA<br>AACAACTCTTCGTCGAACAACACAAACACTACCTCGACGAAAT-<br>CATCGAACAAATCTCCGAATTCTCCAAAAGAGTCATCCTCGCCGACGCCAA<br>CCTCGACAAAGTCCTCTCCGCCTACAACAAACACAGAGACAAACC-<br>CATCAGAGAACAAGCCGAAAACATCATCCACCTCTTCACCCTCACCAAC<br>CTCGGCGCCCCCGCCGCCTTCAAATACTTCGACACCACCATCGACAGAAAAAGATA-<br>CACCTCCACCAAAGAAGTCCTCGACGCCACCCTCATCC<br>ACCAATCCATCACCGGCCTCTACGAAACCAGAATCGACCTCTCC-<br>CAACTCGGCGGCGACGGCGGCGGCTCCCCCAAAAAAAAAAGAAAAGTC | |
| Cas9<br>ORF<br>using<br>low C<br>codons<br>of<br>Table<br>4 (no<br>start<br>or<br>stop<br>codons;<br>suit-<br>able<br>for<br>inclu-<br>sion<br>in<br>fusion | GATAAGAAGTATAGTATTGGATTGGATATTGGAACAAATAGTGTGGGATGGGCTGTGAT-<br>TACAGATGAGTATAAGGTGCCTAGTAAGAAGTTTA<br>AGGTGTTGGGAAATACAGATAGACATAGTATTAAGAAGAATTTGATTG-<br>GAGCTTTGTTGTTTGATAGTGGAGAGACAGCTGAGGCTACAAGATT<br>GAAGAGAACAGCTAGAAGAAGATATACAAGAAGAAAGAATAGAATTTGTTATTTGCAG-<br>GAGATTTTTAGTAATGAGATGGCTAAGGTGGATGAT<br>AGTTTTTTTCATAGATTGGAGGAGAGTTTTTTGGTGGAGGAGGATAAGAAGCATGAGAGA-<br>CATCCTATTTTTGGAAATATTGTGGATGAGGTGG<br>CTTATCATGAGAAGTATCCTACAATTTATCATTTGAGAAAGAAGTTGGTGGATAGTACA-<br>GATAAGGCTGATTTGAGATTGATTTATTTGGCTTT<br>GGCTCATATGATTAAGTTTAGAGGACATTTTTTGATTGAGGGAGATTTGAATCCTGA-<br>TAATAGTGATGTGGATAAGTTGTTTATTCAGTTGGTG<br>CAGACATATAATCAGTTGTTTGAGGAGAATCCTATTAATGCTAGTGGAGTG-<br>GATGCTAAGGCTATTTTGAGTGCTAGATTGAGTAAGAGTAGAA<br>GATTGGAGAATTTGATTGCTCAGTTGCCTGGAGAAGAAGAATGGATTGTTTGGAAAT-<br>TTGATTGCTTTGAGTTTGGGATTGACACCTAATTT<br>TAAGAGTAATTTTGATTGGCTGAGGATGCTAAGTTGCAGTTGAGTAAGGATACATAT-<br>GATGATGATTTGGATAATTTGTTGGCTCAGATTGGA<br>GATCAGTATGCTGATTTGTTTTGGCTGCTAAGAATTTGAGTGATGCTATTTTGTTGAGT-<br>GATATTTTGAGAGTGAATACAGAGATTACAAAGG<br>CTCCTTTGAGTGCTAGTATGATTAAGAGATATGATGAGCATCATCAGGATTTGACAT-<br>TGTTGAAGGCTTTGGTGAGACAGCAGTTGCCTGAGAA<br>GTATAAGGAGATTTTTTTGATCAGAGTAAGAATGGATATGCTGGATATATTGATGGAG-<br>GAGCTAGTCAGGAGGAGTTTTATAAGTTTATTAAG<br>CCTATTTTGGAAGAGTGGATGGAACAGAGGAGTTGTTGGTGAAGTTGAATAGAGGAT-<br>TGTTGAGAAAGCAGAGAACATTTGATAATGAA<br>GTATTCCTCATCAGATTCATTTGGGAGAGTTGCATGCTATTTTGAGAAGACAGGAGGAT-<br>TTTTATCCTTTTTTGAAGGATAATAGAGAGAAGAT<br>TGAGAAGATTTTGACATTTAGAATTCCTTATTATGTGGGACCTTTGGCTAGAG-<br>GAAATAGTAGATTTGCTTGGATGACAAGAAAGAGTGAGGAG<br>ACAATTACACCTTGGAATTTTGAGGAGGTGGTGGATAAGGGAGCTAGTGCTCAGAGTTTT-<br>ATTGAGAGAATGACAAATTTTGATAAGAATTTGC<br>CTAATGAGAAGGTGTTGCCTAAGCATAGTTTGTTGTATGAGTATTTTACAGTGTATAAT-<br>GAGTTGACAAAGGTGAAGTATGTGACAGAGGGAAT<br>GAGAAAGCCTGCTTTTTTGAGTGGAGAGCAGAAGAAGGCTATTGTGGATTTGTTGTTTAA-<br>GACAAATAGAAAGGTGACAGTGAAGCAGTTGAAG<br>GAGGATTATTTTAAGAAGATTGAGTGTTTTGATAGTGTGGAGATTAGTGGAGTGGAGGA-<br>TAGATTTAATGCTAGTTTGGGAACATATCATGATT | 145 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| protein coding sequence) | TGTTGAAGATTATTAAGGATAAGGATTTTTTGGATAATGAGGAGAATGAGGATATTTTG-GAGGATATTGTGTTGACATTGACATTGTTTGAGGA<br>TAGAGAGATGATTGAGGAGAGATTGAAGACATATGCTCATTTGTTTGATGATAAGGTGAT-GAAGCAGTTGAAGAGAAGAAGATATACAGGATGG<br>GGAAGATTGAGTAGAAAGTTGATTAATGGAATTAGAGATAAGCAGAGTGGAAAGACAAT-TTTGGATTTTTTGAAGAGTGATGGATTTGCTAATA<br>GAAATTTTATGCAGTTGATTCATGATGATAGTTTGACATTTAAGGAGGATAT-TCAGAAGGCTCAGGTGAGTGGACAGGGAGATAGTTTGCATGA<br>GCATATTGCTAATTTGGCTGGAAGTCCTGCTATTAAGAAGGGAATTTTGCAGACAGT-GAAGGTGGTGGATGAGTTGGTGAAGGTGATGGGAAGA<br>CATAAGCCTGAGAATATTGTGATTGAGATGGCTAGAGAGAATCA-GACAACACAGAGGGACAGAAGAATAGTAGAGAGAGAATGAAGAGAATTG<br>AGGAGGGAATTAAGGAGTTGGGAAGTCAGATTTTGAAGGAGCATCCTGTGGAGAATA-CACAGTTGCAGAATGAGAAGTTGTATTTGTATTATTT<br>GCAGAATGGAAGAGATATGTATGTGGATCAGGAGTTGGATATTAATAGATTGAGTGAT-TATGATGTGGATCATATTGTGCCTCAGAGTTTTTG<br>AAGGATGATAGTATTGATAATAAGGTGTTGACAAGAAGTGATAAGAATAGAGGAAAGAGT-GATAATGTGCCTAGTGAGGAGGTGGTGAAGAAGA<br>TGAAGAATTATTGGAGACAGTTGTTGAATGCTAAGTTGATTACACAGAGAAAGTTTGA-TAATTTGACAAAGGCTGAGAGAGGAGGATTGAGTGA<br>GTTGGATAAGGCTGGATTTATTAAGACAGTTGGTGGAGACAAGACAGATTA-CAAAGCATGTGGCTCAGATTTTGGATAGTAGAATGAATACA<br>AAGTATGATGAGAATGATAAGTTGATTAGAGAGGTGAAGGTGATTACATT-GAAGAGTAAGTTGGTGAGTGATTTTAGAAAGGATTTTCAGTTTT<br>ATAAGGTGAGAGAGATTAATAATTATCATCATGCTCATGATGCTTATTT-GAATGCTGTGGTGGGAACAGCTTTGATTAAGAAGTATCCTAAGTT<br>GGGAGAGTGAGTTTGTGTATGGAGATTATAAGGTGTATGATGTGAGAAAGATGAT-TGCTAAGAGTGAGCAGGAGATTGGAAAGGCTACAGCTAAG<br>TATTTTTTTATAGTAATATTATGAATTTTTTTAAGACAGAGATTACATTGGCTAATG-GAGAGATTAGAAAGAGACCTTTGATTGAGACAAATG<br>GAGAGACAGGAGAGATTGTGTGGGATAAGGGAAGAGATTTTGCTACAGT-GAGAAAGGTGTTGAGTATGCCTCAGGTGAATATTGTGAAGAAGAC<br>AGAGGTGCAGACAGGAGGATTTAGTAAGGAGAGTATTTTGCCTAAGAGAAATAGTGA-TAAGTTGATTGCTAGAAAGAAGGATTGGGATCCTAAG<br>AAGTATGGAGGATTTGATAGTCCTACAGTGGCTTATAGTGTGTTGGTGGTGGCTAAGGTG-GAGAAGGGAAAGAGTAAGAAGTTGAAGAGTGTGA<br>AGGAGTTGTTGGGAATTACAATTATGGAGAGAAGTAGTTTTGAGAAGAATCCTATTGAT-TTTTTGGAGGCTAAGGGATATAAGGAGGTGAAGAA<br>GGATTTGATTATTAAGTTGCCTAAGTATAGTTTGTTTGAGTTGGAGAATG-GAAGAAAGAGAATGTTGGCTAGTGCTGGAGAGTTGCAGAAGGGA<br>AATGAGTTGGCTTTGCCTAGTAAGTATGTGAATTTTTTGTATTTGGCTAGTCATTAT-GAGAAGTTGAAGGGAAGTCCTGAGGATAATGAGCAGA<br>AGCAGTTGTTTGTGGAGCAGCATAAGCATTATTTGGATGAGATTATTGAGCAGATTAGT-GAGTTTAGTAAGAGAGTGATTTTGGCTGATGCTAA<br>TTTGGATAAGGTGTTGAGTGCTTATAATAAGCATAGATAAGCCTATT-AGAGAGCAGGCTGAGAATATTATTCATTTGTTTACATTGACAAAT<br>TTGGGAGCTCCTGCTGCTTTTAAGTATTTTGATACAACAATTGATAGAAAGAGATATA-CAAGTACAAAGGAGGTGTTGGATGCTACATTGATTC<br>ATCAGAGTATTACAGGATTGTATGAGACAAGAATTGATTTGAGTCAGTTGGGAGGAGATG-GAGGAGGAAGTCCTAAGAAGAAGAGAAAGGGT | |
| Cas9 ORF using low A codons of Table 4 (no start or stop codons; | GACAAGAGTACTCCATCGGCCTGGACATCGGCACCAACTCCGTGGGCTGGGCCGTGAT-CACCGACGAGTACAAGGTGCCCTCCAAGAAGTTCA<br>AGGTGCTGGGCAACACCGACCGGCACTCCATCAAGAAGAACCT-GATCGGCGCCCTGCTGTTCGACTCCGGCGAGACCGCCGAGGCCACCCGGCT<br>GAAGCGGACCGCCCGGCGGCGGTACACCCGGCGGAAGAACCGGATCTGCTACCTGCAG-GAGATCTTCTCCAACGAGATGGCCAAGGTGGACGAC<br>TCCTTCTTCCACCGGCTGGAGGAGTCCTTCCTGGTGGAG-GAGGACAAGAAGCACGAGCGGCACCCCATCTTCGGCAACATCGTGGACGAGGTGG<br>CCTACCACGAGAAGTACCCCACCATCTACCACCTGCGGAAGAAGCTGGTGGACTC-CACCGACAAGGCCGACCTGCGGCTGATCTACCTGGCCCT<br>GGCCCACATGATCAAGTTCCGGGGCCACTTCCTGATCGAGGGCGACCT-GAACCCCGACAACTCCGACGTGGACAAGCTGTTCATCCAGCTGGTG<br>CAGACCTACAACCAGCTGTTCGAGGAGAACCCCATCAACGCCTCCGGCGTGGACGC-CAAGGCCATCCTGTCCGCCCGGCTGTCCAAGTCCCGGC<br>GGCTGGAGAACCT-GATCGCCCAGCTGCCCGGCGAGAAGAAGAACGGCCTGTTCGGCAACCTGATCGCCCTGTCCCTGGGCCTGACCCCCAACTT<br>CAAGTCCAACTTCGACCTGGCCGAGGACGCCAAGCTGCAGCTGTCCAAGGACACC-TACGACGACGACCTGGACAACCTGCTGGCCCAGATCGG<br>GACCAGTACGCCGACCTGTTCCTGGCCGCCAAGAACCTGTCCGACGC-CATCCTGCTGTCCGACATCCTGCGGGTGAACACCGAGATCACCAAGG<br>CCCCCCTGTCCGCCTCCATGATCAAGCGGTACGACGAGCAC-CACCAGGACCTGACCCTGCTGAAGGCCCTGGTGCGGCAGCAGCTGCCCGAGAA<br>GTACAAGGAGATCTTCTTCGACCAGTCCAAGAACGGCTACGCCGGCTA-CATCGACGGCGGCGCCTCCCAGGAGGAGTTCTACAAGTTCATCAAG | 146 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| suitable for inclusion in fusion protein coding sequence) | CCCATCCTGGAGAAGATGGACGGCACCGAGGAGCTGCTGGTGAAGCTGAACCGG-GAGGACCTGCTGCGGAAGCAGCGGACCTTCGACAACGGCT CCATCCCCCACCAGATCCACCTGGGCGAGCTGCACGCCATCCTGCGGCGGCAG-GAGGACTTCTACCCCTTCCTGAAGGACAACCGGGAGAAGAT CGAGAAGATCCTGACCTTCCGGATCCCCTAC-TACGTGGGCCCCCTGGCCCGGGGCAACTCCCGGTTCGCCTGGATGACCCGGAAGTCCGAGGAG ACCATCACCCCCTGGAACTTCGAGGAGGTGGTGGACAAGGGCGCCTCCGCCCAGTCCTT-CATCGAGCGGATGACCAACTTCGACAAGAACCTGC CCAACGAGAAGGTGCTGCCCAAGCACTCCCTGCTGTACGAGTACTTCACCGTGTA-CAACGAGCTGACCAAGGTGAAGTACGTGACCGAGGGCAT GCGGAAGCCCGCCTTCCTGTCCGGCGAGCAGAAGAAGGCCATCGTGGACCTGCTGTTCAA-GACCAACCGGAAGGTGACCGTGAAGCAGCTGAAG GAGGACTACTTCAAGAAGATCGAGTGCTTCGACTCCGTGGAGATCTCCGGCGTG-GAGGACCGGTTCAACGCCTCCCTGGGCACCTACCACGACC TGCTGAAGATCATCAAGGACAAGGACTTCCTGGACAACGAGGAGAACGAGGACATCCTG-GAGGACATCGTGCTGACCCTGACCCTGTTCGAGGA CCGGGAGATGATCGAGGAGCGGCTGAAGACCTACGCCCACCTGTTCGACGACAAGGTGAT-GAAGCAGCTGAAGCGGCGGCGGTACACCGGCTGG GGCCGGCTGTCCCGGAAGCTGATCAACGGCATCCGGGACAAGCAGTCCGGCAAGAC-CATCCTGGACTTCCTGAAGTCCGACGGCTTCGCCAACC GGAACTTCATGCAGCTGATCCACGACGACTCCCTGACCTTCAAGGAGGA-CATCCAGAAGGCCCAGGTGTCCGGCCAGGGCGACTCCCTGCACGA GCACATCGCCAACCTGGCCGGCTCCCCCGCCATCAAGAAGGGCATCCTGCAGACCGT-GAAGGTGGTGGACGAGCTGGTGAAGGTGATGGGCCGG CACAAGCCCGAGAACATCGTGATCGAGATGGCCCGGGAGAACCAGAC-CACCCAGAAGGGCCAGAAGAACTCCCGGGAGCGGATGAAGCGGATCG AGGAGGGCATCAAGGAGCTGGGCTCCCAGATCCTGAAGGAGCACCCCGTG-GAGAACACCCAGCTGCAGAACGAGAAGCTGTACCTGTACTACCT GCAGAACGGCCGGGACATGTACGTGGACCAGGAGCTGGACATCAACCGGCTGTCCGAC-TACGACGTGGACCACATCGTGCCCCAGTCCTTCCTG AAGGACGACTC-CATCGACAACAAGGTGCTGACCCGGTCCGACAAGAACCGGGGCAAGTCCGACAACGTGCCCTCCGAGGAGGTGGTGAAGAAGA TGAAGAACTACTGGCGGCAGCTGCTGAACGCCAAGCTGATCACCCAGCG-GAAGTTCGACAACCTGACCAAGGCCGAGCGGGGCGGCCTGTCCGA GCTGGACAAGGCCGGCTTCATCAAGCGGCAGCTGGTGGAGACCCGGCAGATCAC-CAAGCACGTGGCCCAGATCCTGGACTCCCGGATGAACACC AAGTACGACGAGAACGACAAGCTGATCCGGGAGGTGAAGGTGATCACCCTGAAGTC-CAAGCTGGTGTCCGACTTCCGGAAGGACTTCCAGTTCT ACAAGGTGCGGGAGATCAACAACTACCACCACGCCCACGACGCCTACCT-GAACGCCGTGGTGGGCACCGCCCTGATCAAGAAGTACCCCAAGCT GGAGTCCGAGTTCGTGTACGGCGACTACAAGGTGTACGACGTGCGGAAGATGATCGC-CAAGTCCGAGCAGGAGATCGGCAAGGCCACCGCCAAG TACTTCTTCTACTCCAACATCATGAACTTCTTCAAGACCGAGATCACCCTGGC-CAACGGCGAGATCCGGAAGCGGCCCCTGATCGAGACCAACG GCGAGACCGGCGAGATCGTGTGGGACAAGGGCCGGGACTTCGCCACCGTGCG-GAAGGTGCTGTCCATGCCCCAGGTGAACATCGTGAAGAAGAC CGAGGTGCAGACCGGCGGCTTCTCCAAGGAGTCCATCCTGCCCAAGCG-GAACTCCGACAAGCTGATCGCCCGGAAGAAGGACTGGGACCCCAAG AAGTACGGCGGCTTCGACTCCCCCACCGTGGCCTACTCCGTGCTGGTGGTGGCCAAGGTG-GAGAAGGGCAAGTCCAAGAAGCTGAAGTCCGTGA AGGAGCTGCTGGGCATCACCATCATGGAGCGGTCCTCCTTCGAGAAGAACCC-CATCGACTTCCTGGAGGCCAAGGGCTACAAGGAGGTGAAGAA GGACCTGATCATCAAGCTGCCCAAGTACTCCCTGTTCGAGCTGGAGAACGGCCGGAAGCG-GATGCTGGCCTCCGCCGGCGAGCTGCAGAAGGGC AACGAGCTGGCCCTGCCCTCCAAGTACGTGAACTTCCTGTACCTGGCCTCCCAC-TACGAGAAGCTGAAGGGCTCCCCCGAGGACAACGAGCAGA AGCAGCTGTTCGTGGAGCAGCACAAGCACTACCTGGACGAGATCATCGAGCA-GATCTCCGAGTTCTCCAAGCGGGTGATCCTGGCCGACGCCAA CCTGGACAAGGTGCTGTCCGCCTACAACAAGCACCGGGACAAGCCCATCCGG-GAGCAGGCCGAGAACATCATCCACCTGTTCACCCTGACCAAC CTGGGCGCCCCCGCCGCCTTCAAGTACTTCGACACCACCATCGACCGGAAGCGGTA-CACCTCCACCAAGGAGGTGCTGGACGCCACCCTGATCC ACCAGTCCATCACCGGCCTGTACGAGACCCG-GATCGACCTGTCCCAGCTGGGCGGCGACGGCGGCGGCTCCCCCAAGAAGAAGCGGAAGGTG | |
| Cas9 ORF using low A/U | GACAAGAAGTACAGCATCGGCCTGGACATCGGCACCAACAGCGTGGGCTGGGCCGTGAT-CACCGACGAGTACAAGGTGCCCAGCAAGAAGTTCA AGGTGCTGGGCAACACCGACCGGCACAGCATCAAGAAGAACCT-GATCGGCGCCCTGCTGTTCGACAGCGGCGAGACCGCCGAGGCCACCCGGCT GAAGCGGACCGCCCGGCGGCGGTACACCCGGCGGAAGAACCGGATCTGCTACCTGCAG-GAGATCTTCAGCAACGAGATGGCCAAGGTGGACGAC AGCTTCTTCCACCGGCTGGAGGAGAGCTTCCTGGTGGAG-GAGGACAAGAAGCACGAGCGGCACCCCATCTTCGGCAACATCGTGGACGAGGTGG CCTACCACGAGAAGTACCCCACCATCTACCACCTGCGC-GAAGAAGCTGGTGGACAGCACCGACAAGGCCGACCTGCGGCTGATCTACCTGGCCCT | 147 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| codons of Table 4 (no start or stop codons; suitable for inclusion in fusion protein coding sequence) | GGCCCACATGATCAAGTTCCGGGGCCACTTCCTGATCGAGGGCGACCT-GAACCCGACAACAGCGACGTGGACAAGCTGTTCATCCAGCTGGTG CAGACCTACAACCAGCTGTTCGAGGAGAACCCCATCAACGCCAGCGGCGTGGACGC-CAAGGCCATCCTGAGCGCCCGGCTGAGCAAGAGCCGGC GGCTGGAGAACCT-GATCGCCCAGCTGCCCGGCGAGAAGAAGAACGGCCTGTTCGGCAACCTGATCGCCCTGAGCCTGGGCCTGACCCCCAACTT CAAGAGCAACTTCGACCTGGCCGAGGACGCCAAGCTGCAGCTGAGCAAGGACACC-TACGACGACGACCTGGACAACCTGCTGGCCCAGATCGGC GACCAGTACGCCGACCTGTTCCTGGCCGCCAAGAACCTGAGCGACGCCATCCTGCT-GAGCGACATCCTGCGGGTGAACACCGAGATCACCAAGG CCCCCCTGAGCGCCAGCATGATCAAGCGGTACGACGAGCAC-CACCAGGACCTGACCCTGCTGAAGGCCCTGGTGCGGCAGCAGCTGCCCGAGAA GTACAAGGAGATCTTCTTCGACCAGAGCAAGAACGGCTACGCCGGCTA-CATCGACGGCGGCGCCAGCCAGGAGGAGTTCTACAAGTTCATCAAG CCCATCCTGGAGAAGATGGACGGCACCGAGGAGCTGCTGGTGAAGCTGAACCGG-GAGGACCTGCTGCGGAAGCAGCGGACCTTCGACAACGGCA GCATCCCCCACCAGATCCACCTGGGCGAGCTGCACGCCATCCTGCGGCGGCAG-GAGGACTTCTACCCCTTCCTGAAGGACAACCGGGAGAAGAT CGAGAAGATCCTGACCTTCCGGATCCCCTAC-TACGTGGGCCCCCTGGCCCGGGGCAACAGCCGGTTCGCCTGGATGACCCGGAAGAGCGAGGAG ACCATCACCCCCTGGAACTTCGAGGAGGTGGTGGACAAGGGCGCCAGCGCCCAGAGCTT-CATCGAGCGGATGACCAACTTCGACAAGAACCTGC CCAACGAGAAGGTGCTGCCCAAGCACAGCCTGCTGTACGAGTACTTCACCGTGTA-CAACGAGCTGACCAAGGTGAAGTACGTGACCGAGGGCAT GCGGAAGCCCGCCTTCCTGAGCGGCGAGCAGAAGAAGGCCATCGTGGACCTGCTGTTCAA-GACCAACCGGAAGGTGACCGTGAAGCAGCTGAAG GAGGACTACTTCAAGAAGATCGAGTGCTTCGACAGCGTGGAGATCAGCGGCGTG-GAGGACCGGTTCAACGCCAGCCTGGGCACCTACCACGACC TGCTGAAGATCATCAAGGACAAGGACTTCCTGGACAACGAGGAGAACGAGGACATCCTG-GAGGACATCGTGCTGACCCTGACCCTGTTCGAGGA CCGGGAGATGATCGAGGAGCGGCTGAAGACCTACGCCCACCTGTTCGACGACAAGGTGAT-GAAGCAGCTGAAGCGGCGGCGGTACACCGGCTGG GGCCGGCTGAGCCGGAAGCTGATCAACGGCATCCGGGACAAGCAGAGCGGCAAGAC-CATCCTGGACTTCCTGAAGAGCGACGGCTTCGCCAACC GGAACTTCATGCAGCTGATCCACGACGACAGCCTGACCTTCAAGGAGGA-CATCCAGAAGGCCCAGGTGAGCGGCCAGGGCGACAGCCTGCACGA GCACATCGCCAACCTGGCCGGCAGCCCCGCCATCAAGAAGGGCATCCTGCAGACCGT-GAAGGTGGTGGACGAGCTGGTGAAGGTGATGGGCCGG CACAAGCCCGAGAACATCGTGATCGAGATGGCCCGGGAGAACCAGAC-CACCCAGAAGGGCCAGAAGAACAGCCGGGAGCGGATGAAGCGGATCG AGGAGGGCATCAAGGAGCTGGGCAGCCAGATCCTGAAGGAGCACCCCGTG-GAGAACACCCAGCTGCAGAACGAGAAGCTGTACCTGTACTACCT GCAGAACGGCCGGGACATGTACGTGGACCAGGAGCTGGACATCAACCGGCTGAGCGAC-TACGACGTGGACCACATCGTGCCCCAGAGCTTCCTG AAGGACGACAGCATCGACAACAAGGTGCTGACCCG-GAGCGACAAGAACCGGGGCAAGAGCGACAACGTGCCCAGCGAGGAGGTGGTGAAGAAGA TGAAGAACTACTGGCGGCAGCTGCTGAACGCCAAGCTGATCACCCAGCG-GAAGTTCGACAACCTGACCAAGGCCGAGCGGGGCGGCCTGAGCGA GCTGGACAAGGCCGGCTTCATCAAGCGGCAGCTGGTGGAGACCCGGCAGATCAC-CAAGCACGTGGCCCAGATCCTGGACAGCCGGATGAACACC AAGTACGACGAGAACGACAAGCTGATCCGGGAGGTGAAGGTGATCACCCT-GAAGAGCAAGCTGGTGAGCGACTTCCGGAAGGACTTCCAGTTCT ACAAGGTGCGGGAGATCAACAACTACCACCACGCCCACGACGCCTACCT-GAACGCCGTGGTGGGCACCGCCCTGATCAAGAAGTACCCCAAGCT GGAGAGCGAGTTCGTGTACGGCGACTACAAGGTGTACGACGTGCGGAAGATGATCGC-CAAGAGCGAGCAGGAGATCGGCAAGGCCACCGCCAAG TACTTCTTCTACAGCAACATCATGAACTTCTTCAAGACCGAGATCACCCTGGC-CAACGGCGAGATCCGGAAGCGGCCCCTGATCGAGACCAACG GCGAGACCGGCGAGATCGTGTGGGACAAGGGCCGGGACTTCGCCACCGTGCG-GAAGGTGCTGAGCATGCCCCAGGTGAACATCGTGAAGAAGAC CGAGGTGCAGACCGGCGGCTTCAGCAAGGAGAGCATCCTGCCCAAGCG-GAACAGCGACAAGCTGATCGCCCGGAAGAAGGACTGGGACCCCAAG AAGTACGGCGGCTTCGACAGCCCCACCGTGGCCTACAGCGTGCTGGTGGTGGCCAAGGTG-GAGAAGGGCAAGAGCAAGAAGCTGAAGAGCGTGA AGGAGCTGCTGGGCATCACCATCATGGAGCGGAGCAGCTTCGAGAAGAACCC-CATCGACTTCCTGGAGGCCAAGGGCTACAAGGAGGTGAAGAA GGACCTGATCATCAAGCTGCCCAAGTACAGCCTGTTCGAGCTGGAGAACGGCCGGAAGCG-GATGCTGGCCAGCGCCGGCGAGCTGCAGAAGGGC AACGAGCTGGCCCTGCCCAGCAAGTACGTGAACTTCCTGTACCTGGCCAGCCAC-TACGAGAAGCTGAAGGGCAGCCCCGAGGACAACGAGCAGA AGCAGCTGTTCGTGGAGCAGCACAAGCACTACCTGGACGAGATCATCGAGCA-GATCAGCGAGTTCAGCAAGCGGGTGATCCTGGCCGACGCCAA CCTGGACAAGGTGCTGAGCGCCTACAACAAGCACCGGGACAAGCCCATCCGG-GAGCAGGCCGAGAACATCATCCACCTGTTCACCCTGACCAAC CTGGGCGCCCCCGCCGCCTTCAAGTACTTCGACACCACCATCGACCGGAAGCGGTA-CACCAGCACCAAGGAGGTGCTGGACGCCACCCTGATCC | |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | ACCAGAGCATCACCGGCCTGTACGAGACCCGGATCGACCT-GAGCCAGCTGGGCGGCGACGGCGGCGGCAGCCCCAAGAAGAAGCGGAAGGTG | |
| Cas9 ORF using low A codons of Table 4, with two C-terminal NLS sequences (no start or stop codons; suitable for inclusion in fusion protein coding sequence) | GACAAGAAGTACTCCATCGGCCTGGACATCGGCACCAACTCCGTGGGCTGGGCCGTGAT-CACCGACGAGTACAAGGTGCCCTCCAAGAAGTTCAAGGTGCTGGGCAACACCGACCGGCACTCCATCAAGAAGAACCT-GATCGGCGCCCTGCTGTTCGACTCCGGCGAGACCGCCGAGGCCACCCGGCTGAAGCGGACCGCCCGGCGGCGGTACACCCGGCGGAAGAACCGGATCTGCTACCTGCAG-GAGATCTTCTCCAACGAGATGGCCAAGGTGGACGACTCCTTCTTCCACCGGCTGGAGGAGTCCTTCCTGGTGGAG-GAGGACAAGAAGCACGAGCGGCACCCCATCTTCGGCAACATCGTGGACGAGGTGGCCTACCACGAGAAGTACCCCACCATCTACCACCTGCGGAAGAAGCTGGTGGACTC-CACCGACAAGGCCGACCTGCGGCTGATCTACCTGGCCCTGGCCCACATGATCAAGTTCCGGGGCCACTTCCTGATCGAGGGCGACCT-GAACCCCGACAACTCCGACGTGGACAAGCTGTTCATCCAGCTGGTGCAGACCTACAACCAGCTGTTCGAGGAGAACCCCATCAACGCCTCCGGCGTGGACGC-CAAGGCCATCCTGTCCGCCCGGCTGTCCAAGTCCCGGCGGCTGGAGAACCT-GATCGCCCAGCTGCCCGGCGAGAAGAAGAACGGCCTGTTCGGCAACCTGATCGCCCTGTCCCTGGGCCTGACCCCCAACTTCAAGTCCAACTTCGACCTGGCCGAGGACGCCAAGCTGCAGCTGTCCAAGGACACC-TACGACGACGACCTGGACAACCTGCTGGCCCAGATCGGCGACCAGTACGCCGACCTGTTCCTGGCCGCCAAGAACCTGTCCGACGC-CATCCTGCTGTCCGACATCCTGCGGGTGAACACCGAGATCACCAAGGCCCCCCTGTCCGCCTCCATGATCAAGCGGTACGACGAGCAC-CACCAGGACCTGACCCTGCTGAAGGCCCTGGTGCGGCAGCAGCTGCCCGAGAAGTACAAGGAGATCTTCTTCGACCAGTCCAAGAACGGCTACGCCGGCTA-CATCGACGGCGGCGCCTCCCAGGAGGAGTTCTACAAGTTCATCAAGCCCATCCTGGAGAAGATGGACGGCACCGAGGAGCTGCTGGTGAAGCTGAACCGG-GAGGACCTGCTGCGGAAGCAGCGGACCTTCGACAACGGCTCCATCCCCCACCAGATCCACCTGGGCGAGCTGCACGCCATCCTGCGGCGGCAG-GAGGACTTCTACCCCTTCCTGAAGGACAACCGGGAGAAGATCGAGAAGATCCTGACCTTCCGGATCCCCTAC-TACGTGGGCCCCCTGGCCCGGGGCAACTCCCGGTTCGCCTGGATGACCCGGAAGTCCGAGGAGACCATCACCCCCTGGAACTTCGAGGAGGTGGTGGACAAGGGCGCCTCCGCCCAGTCCTT-CATCGAGCGGATGACCAACTTCGACAAGAACCTGCCCAACGAGAAGGTGCTGCCCAAGCACTCCCTGCTGTACGAGTACTTCACCGTGTA-CAACGAGCTGACCAAGGTGAAGTACGTGACCGAGGGCATGCGGAAGCCCGCCTTCCTGTCCGGCGAGCAGAAGAAGGCCATCGTGGACCTGCTGTTCAA-GACCAACCGGAAGGTGACCGTGAAGCAGCTGAAGGAGGACTACTTCAAGAAGATCGAGTGCTTCGACTCCGTGGAGATCTCCGGCGTG-GAGGACCGGTTCAACGCCTCCCTGGGCACCTACCACGACCTGCTGAAGATCATCAAGGACAAGGACTTCCTGGACAACGAGGAGAACGAGGACATCCTG-GAGGACATCGTGCTGACCCTGACCCTGTTCGAGGACCGGGAGATGATCGAGGAGCGGCTGAAGACCTACGCCCACCTGTTCGACGACAAGGTGAT-GAAGCAGCTGAAGCGGCGGCGGTACACCGGCTGGGGCCGGCTGTCCCGGAAGCTGATCAACGGCATCCGGGACAAGCAGTCCGGCAAGAC-CATCCTGGACTTCCTGAAGTCCGACGGCTTCGCCAACCGGAACTTCATGCAGCTGATCCACGACGACTCCCTGACCTTCAAGGAGGA-CATCCAGAAGGCCCAGGTGTCCGGCCAGGGCGACTCCCTGCACGAGCACATCGCCAACCTGGCCGGCTCCCCCGCCATCAAGAAGGGCATCCTGCAGACCGT-GAAGGTGGTGGACGAGCTGGTGAAGGTGATGGGCCGGCACAAGCCCGAGAACATCGTGATCGAGATGGCCCGGGAGAACCAGAC-CACCCAGAAGGGCCAGAAGAACTCCCGGGAGCGGATGAAGCGGATCGAGGAGGGCATCAAGGAGCTGGGCTCCCAGATCCTGAAGGAGCACCCCGTG-GAGAACACCCAGCTGCAGAACGAGAAGCTGTACCTGTACTACCTGCAGAACGGCCGGGACATGTACGTGGACCAGGAGCTGGACATCAACCGGCTGTCCGAC-TACGACGTGGACCACATCGTGCCCCAGTCCTTCCTGAAGGACGACTC-CATCGACAACAAGGTGCTGACCCGGTCCGACAAGAACCGGGGCAAGTCCGACAACGTGCCCTCCGAGGAGGTGGTGAAGAAGATGAAGAACTACTGGCGGCAGCTGCTGAACGCCAAGCTGATCACCCAGCG-GAAGTTCGACAACCTGACCAAGGCCGAGCGGGGCGGCCTGTCCGAGCTGGACAAGGCCGGCTTCATCAAGCGGCAGCTGGTGGAGACCCGGCAGATCAC-CAAGCACGTGGCCCAGATCCTGGACTCCCGGATGAACACCAAGTACGACGAGAACGACAAGCTGATCCGGGAGGTGAAGGTGATCACCCTGAAGTC-CAAGCTGGTGTCCGACTTCCGGAAGGACTTCCAGTTCTACAAGGTGCGGGAGATCAACAACTACCACCACGCCCACGACGCCTACCT-GAACGCCGTGGTGGGCACCGCCCTGATCAAGAAGTACCCCAAGCTGGAGTCCGAGTTCGTGTACGGCGACTACAAGGTGTACGACGTGCGGAAGATGATCGC-CAAGTCCGAGCAGGAGATCGGCAAGGCCACCGCCAAGTACTTCTTCTACTCCAACATCATGAACTTCTTCAAGACCGAGATCACCCTGGC-CAACGGCGAGATCCGGAAGCGGCCCCTGATCGAGACCAACGGCGAGACCGGCGAGATCGTGTGGGACAAGGGCCGGGACTTCGCCACCGTGCG-GAAGGTGCTGTCCATGCCCCAGGTGAACATCGTGAAGAAGAC-CGAGGTGCAGACCGGCGGCTTCTCCAAGGAGTCCATCCTGCCCAAGCG-GAACTCCGACAAGCTGATCGCCCGGAAGAAGGACTGGGACCCCAAG | 148 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | AAGTACGGCGGCTTCGACTCCCCCACCGTGGCCTACTCCGTGCTGGTGGTGGCCAAGGTG-GAGAAGGGCAAGTCCAAGAAGCTGAAGTCCGTGA AGGAGCTGCTGGGCATCACCATCATGGAGCGGTCCTCCTTCGAGAAGAACCC-CATCGACTTCCTGGAGGCCAAGGGCTACAAGGAGGTGAAGAA GGACCTGATCATCAAGCTGCCCAAGTACTCCCTGTTCGAGCTGGAGAACGGCCGGAAGCG-GATGCTGGCCTCCGCCGGCGAGCTGCAGAAGGGC AACGAGCTGGCCCTGCCCTCCAAGTACGTGAACTTCCTGTACCTGGCCTCCCAC-TACGAGAAGCTGAAGGGCTCCCCCGAGGACAACGAGCAGA AGCAGCTGTTCGTGGAGCAGCACAAGCACTACCTGGACGAGATCATCGAGCA-GATCTCCGAGTTCTCCAAGCGGGTGATCCTGGCCGACGCCAA CCTGGACAAGGTGCTGTCCGCCTACAACAAGCACCGGGACAAGCCCATCCGG-GAGCAGGCCGAGAACATCATCCACCTGTTCACCCTGACCAAC CTGGGCGCCCCCGCCGCCTTCAAGTACTTCGACACCACCATCGACCGGAAGCGGTA-CACCTCCACCAAGGAGGTGCTGGACGCCACCCTGATCC ACCAGTCCATCACCGGCCTGTACGAGACCCG-GATCGACCTGTCCCAGCTGGGCGGCGACGGCTCCGGCTCCCCCAAGAAGAAGCGGAAGGTGGA CGGCTCCCCCAAGAAGAAGCGGAAGGTGGACTCCGGC | |
| Cas9 nickase ORF using low A codons of Table 4 (no NLS and no start or stop codons; suitable for inclusion in fusion protein coding sequence) | GACAAGAAGTACTCCATCGGCCTGGCCATCGGCACCAACTCCGTGGGCTGGGCCGTGAT-CACCGACGAGTACAAGGTGCCCTCCAAGAAGTTCA AGGTGCTGGGCAACACCGACCGGCACTCCATCAAGAAGAACCT-GATCGGCGCCCTGCTGTTCGACTCCGGCGAGACCGCCGAGGCCACCCGGCT GAAGCGGACCGCCCGGCGGCGGTACACCCGGCGGAAGAACCGGATCTGCTACCTGCAG-GAGATCTTCTCCAACGAGATGGCCAAGGTGGACGAC TCCTTCTTCCACCGGCTGGAGGAGTCCTTCCTGGTGGAG-GAGGACAAGAAGCACGAGCGGCACCCCATCTTCGGCAACATCGTGGACGAGGTGG CCTACCACGAGAAGTACCCCACCATCTACCACCTGCGGAAGAAGCTGGTGGACTC-CACCGACAAGGCCGACCTGCGGCTGATCTACCTGGCCCT GGCCCACATGATCAAGTTCCGGGGCCACTTCCTGATCGAGGGCGACCT-GAACCCCGACAACTCCGACGTGGACAAGCTGTTCATCCAGCTGGTG CAGACCTACAACCAGCTGTTCGAGGAGAACCCCATCAACGCCTCCGGCGTGGACGC-CAAGGCCATCCTGTCCGCCCGGCTGTCCAAGTCCCGGC GGCTGGAGAACCT-GATCGCCCAGCTGCCCGGCGAGAAGAAGAACGGCCTGTTCGGCAACCTGATCGCCCTGTCCCTGGGCCTGACCCCCAACTT CAAGTCCAACTTCGACCTGGCCGAGGACGCCAAGCTGCAGCTGTCCAAGGACACC-TACGACGACGACCTGGACAACCTGCTGGCCCAGATCGGC GACCAGTACGCCGACCTGTTCCTGGCCGCCAAGAACCTGTCCGACGC-CATCCTGCTGTCCGACATCCTGCGGGTGAACACCGAGATCACCAAGG CCCCCCTGTCCGCCTCCATGATCAAGCGGTACGACGAGCAC-CACCAGGACCTGACCCTGCTGAAGGCCCTGGTGCGGCAGCAGCTGCCCGAGAA GTACAAGGAGATCTTCTTCGACCAGTCCAAGAACGGCTACGCCGGCTA-CATCGACGGCGGCGCCTCCCAGGAGGAGTTCTACAAGTTCATCAAG CCCATCCTGGAGAAGATGGACGGCACCGAGGAGCTGCTGGTGAAGCTGAACCGG-GAGGACCTGCTGCGGAAGCAGCGGACCTTCGACAACGGCT CCATCCCCCACCAGATCCACCTGGGCGAGCTGCACGCCATCCTGCGGCGGCAG-GAGGACTTCTACCCCTTCCTGAAGGACAACCGGGAGAAGAT CGAGAAGATCCTGACCTTCCGGATCCCCTAC-TACGTGGGCCCCCTGGCCCGGGGCAACTCCCGGTTCGCCTGGATGACCCGGAAGTCCGAGGAG ACCATCACCCCCTGGAACTTCGAGGAGGTGGTGGACAAGGGCGCCTCCGCCCAGTCCTT-CATCGAGCGGATGACCAACTTCGACAAGAACCTGC CCAACGAGAAGGTGCTGCCCAAGCACTCCCTGCTGTACGAGTACTTCACCGTGTA-CAACGAGCTGACCAAGGTGAAGTACGTGACCGAGGGCAT GCGGAAGCCCGCCTTCCTGTCCGGCGAGCAGAAGAAGGCCATCGTGGACCTGCTGTTCAA-GACCAACCGGAAGGTGACCGTGAAGCAGCTGAAG GAGGACTACTTCAAGAAGATCGAGTGCTTCGACTCCGTGGAGATCTCCGGCGTG-GAGGACCGGTTCAACGCCTCCCTGGGCACCTACCACGACC TGCTGAAGATCATCAAGGACAAGGACTTCCTGGACAACGAGGAGAACGAGGACATCCTG-GAGGACATCGTGCTGACCCTGACCCTGTTCGAGGA CCGGGAGATGATCGAGGAGCGGCTGAAGACCTACGCCCACCTGTTCGACGACAAGGTGAT-GAAGCAGCTGAAGCGGCGGCGGTACACCGGCTGG GGCCGGCTGTCCCGGAAGCTGATCAACGGCATCCGGGACAAGCAGTCCGGCAAGAC-CATCCTGGACTTCCTGAAGTCCGACGGCTTCGCCAACC GGAACTTCATGCAGCTGATCCACGACGACTCCCTGACCTTCAAGGAGGA-CATCCAGAAGGCCCAGGTGTCCGGCCAGGGCGACTCCCTGCACGA GCACATCGCCAACCTGGCCGGCTCCCCCGCCATCAAGAAGGGCATCCTGCAGACCGT-GAAGGTGGTGGACGAGCTGGTGAAGGTGATGGGCCGG CACAAGCCCGAGAACATCGTGATCGAGATGGCCCGGGAGAACCAGAC-CACCCAGAAGGGCCAGAAGAACTCCCGGGAGCGGATGAAGCGGATCG AGGAGGGCATCAAGGAGCTGGGCTCCCAGATCCTGAAGGAGCACCCCGTG-GAGAACACCCAGCTGCAGAACGAGAAGCTGTACCTGTACTACCT GCAGAACGGCCGGGACATGTACGTGGACCAGGAGCTGGACATCAACCGGCTGTCCGAC-TACGACGTGGACCACATCGTGCCCCAGTCCTTCCTG AAGGACGACTC-CATCGACAACAAGGTGCTGACCCGGTCCGACAAGAACCGGGGCAAGTCCGACAACGTGCCCTCCGAGGAGGTGGTGAAGAAGA TGAAGAACTACTGGCGGCAGCTGCTGAACGCCAAGCTGATCACCCAGCG-GAAGTTCGACAACCTGACCAAGGCCGAGCGGGGCGGCCTGTCCGA | 149 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | GCTGGACAAGGCCGGCTTCATCAAGCGGCAGCTGGTGGAGACCCGGCAGATCAC-<br>CAAGCACGTGGCCCAGATCCTGGACTCCCGGATGAACACC<br>AAGTACGACGAGAACGACAAGCTGATCCGGGAGGTGAAGGTGATCACCCTGAAGTC-<br>CAAGCTGGTGTCCGACTTCCGGAAGGACTTCCAGTTCT<br>ACAAGGTGCGGGAGATCAACAACTACCACCACGCCCACGACGCCTACCT-<br>GAACGCCGTGGTGGGCACCGCCCTGATCAAGAAGTACCCCAAGCT<br>GGAGTCCGAGTTCGTGTACGGCGACTACAAGGTGTACGACGTGCGGAAGATGATCGC-<br>CAAGTCCGAGCAGGAGATCGGCAAGGCCACCGCCAAG<br>TACTTCTTCTACTCCAACATCATGAACTTCTTCAAGACCGAGATCACCCTGGC-<br>CAACGGCGAGATCCGGAAGCGGCCCCTGATCGAGACCAACG<br>GCGAGACCGGCGAGATCGTGTGGGACAAGGGCCGGGACTTCGCCACCGTGCG-<br>GAAGGTGCTGTCCATGCCCCAGGTGAACATCGTGAAGAAGAC<br>CGAGGTGCAGACCGGCGGCTTCTCCAAGGAGTCCATCCTGCCCAAGCG-<br>GAACTCCGACAAGCTGATCGCCCGGAAGAAGGACTGGGACCCCAAG<br>AAGTACGGCGGCTTCGACTCCCCCACCGTGGCCTACTCCGTGCTGGTGGTGGCCAAGGTG-<br>GAGAAGGGCAAGTCCAAGAAGCTGAAGTCCGTGA<br>AGGAGCTGCTGGGCATCACCATCATGGAGCGGTCCTCCTTCGAGAAGAACCC-<br>CATCGACTTCCTGGAGGCCAAGGGCTACAAGGAGGTGAAGAA<br>GGACCCTGATCATCAAGCTGCCCAAGTACTCCCTGTTCGAGCTGGAGAACGGCCGGAAGCG-<br>GATGCTGGCCTCCGCCGGCGAGCTGCAGAAGGGC<br>AACGAGCTGGCCCTGCCCTCCAAGTACGTGAACTTCCTGTACCTGGCCTCCCAC-<br>TACGAGAAGCTGAAGGGCTCCCCCGAGGACAACGAGCAGA<br>AGCAGCTGTTCGTGGAGCAGCACAAGCACTACCTGGACGAGATCATCGAGCA-<br>GATCTCCGAGTTCTCCAAGCGGGTGATCCTGGCCGACGCCAA<br>CCTGGACAAGGTGCTGTCCGCCTACAACAAGCACGGGACAAGCCCATCCGG-<br>GAGCAGGCCGAGAACATCATCCACCTGTTCACCCTGACCAAC<br>CTGGGCGCCCCCGCCGCCTTCAAGTACTTCGACACCACCATCGACCGGAAGCGGTA-<br>CACCTCCACCAAGGAGGTGCTGGACGCCACCCTGATCC<br>ACCAGTCCATCACCGGCCTGTACGAGACCCG-<br>GATCGACCTGTCCCAGCTGGGCGGCGACGGCGGCGGCTCCCCCAAGAAGAAGCGGAAGGTG | |
| Cas9 nickase ORF using low A codons of Table 4 (no NLS and no start or stop codons; suitable for inclusion in | GACAAGAAGTACTCCATCGGCCTGGCCATCGGCACCAACTCCGTGGGCTGGGCCGTGAT-<br>CACCGACGAGTACAAGGTGCCCTCCAAGAAGTTCA<br>AGGTGCTGGGCAACACCGACCGGCACTCCATCAAGAAGAACCT-<br>GATCGGCGCCCTGCTGTTCGACTCCGGCGAGACCGCCGAGGCCACCCGGCT<br>GAAGCGGACCGCCCGGCGGCGGTACACCCGGCGGAAGAACCGGATCTGCTACCTGCAG-<br>GAGATCTTCTCCAACGAGATGGCCAAGGTGGACGAC<br>TCCTTCTTCCACCGGCTGGAGGAGTCCTTCCTGGTGGAG-<br>GAGGACAAGAAGCACGAGCGGCACCCCATCTTCGGCAACATCGTGGACGAGGTGG<br>CCTACCACGAGAAGTACCCCACCATCTACCACCTGCGGAAGAAGCTGGTGGACTC-<br>CACCGACAAGGCCGACCTGCGGCTGATCTACCTGGCCCT<br>GGCCCACATGATCAAGTTCCGGGGCCACTTCCTGATCGAGGGCGACCT-<br>GAACCCCGACAACTCCGACGTGGACAAGCTGTTCATCCAGCTGGTG<br>CAGACCTACAACCAGCTGTTCGAGGAGAACCCCATCAACGCCTCCGGCGTGGACGC-<br>CAAGGCCATCCTGTCCGCCCGGCTGTCCAAGTCCCGGC<br>GGCTGGAGAACCT-<br>GATCGCCCAGCTGCCCGGCGAGAAGAAGAACGGCCTGTTCGGCAACCTGATCGCCCTGTCCCTGGGCCTGACCCCCAACTT<br>CAAGTCCAACTTCGACCTGGCCGAGGACGCCAAGCTGCAGCTGTCCAAGGACACC-<br>TACGACGACGACCTGGACAACCTGCTGGCCCAGATCGGC<br>GACCAGTACGCCGACCTGTTCCTGGCCGCCAAGAACCTGTCCGACGC-<br>CATCCTGCTGTCCGACATCCTGCGGGTGAACACCGAGATCACCAAGG<br>CCCCCCTGTCCGCCTCCATGATCAAGCGGTACGACGAGCAC-<br>CACCCAGGACCTGACCCTGCTGAAGGCCCTGGTGCGGCAGCAGCTGCCCGAGAA<br>GTACAAGGAGATCTTCTTCGACCAGTCCAAGAACGGCTACGCCGGCTA-<br>CATCGACGGCGGCGCCTCCCAGGAGGAGTTCTACAAGTTCATCAAG<br>CCCATCCTGGAGAAGATGGACGGCACCGAGGAGCTGCTGGTGAAGCTGAACCGG-<br>GAGGACCTGCTGCGGAAGCAGCGGACCTTCGACAACGGCT<br>CCATCCCCCACCAGATCCACCTGGGCGAGCTGCACGCCATCCTGCGGCGGCAG-<br>GAGGACTTCTACCCCTTCCTGAAGGACAACCGGGAGAAGAT<br>CGAGAAGATCCTGACCTTCCGGATCCCCTAC-<br>TACGTGGGCCCCCTGGCCCGGGGCAACTCCCGGTTCGCCTGGATGACCCGGAAGTCCGAGGAG<br>ACCATCACCCCCTGGAACTTCGAGGAGGTGGTGGACAAGGGCGCCTCCGCCCAGTCCTT-<br>CATCGAGCGGATGACCAACTTCGACAAGAACCTGC<br>CCAACGAGAAGGTGCTGCCCAAGCACTCCCTGCTGTACGAGTACTTCACCGTGTA-<br>CAACGAGCTGACCAAGGTGAAGTACGTGACCGAGGGCAT<br>GCGGAAGCCCGCCTTCCTGTCCGGCGAGCAGAAGAAGGCCATCGTGGACCTGCTGTTCAA-<br>GACCAACCGGAAGGTGACCGTGAAGCAGCTGAAG<br>GAGGACTACTTCAAGAAGATCGAGTGCTTCGACTCCGTGGAGATCTCCGGCGTG-<br>GAGGACCGGTTCAACGCCTCCCTGGGCACCTACCACGACC<br>TGCTGAAGATCATCAAGGACAAGGACTTCCTGGACAACGAGGAGAACGAGGACATCCTG-<br>GAGGACATCGTGCTGACCCTGACCCTGTTCGAGGA<br>CCGGGAGATGATCGAGGAGCGGCTGAAGACCTACGCCCACCTGTTCGACGACAAGGTGAT-<br>GAAGCAGCTGAAGCGGCGCCGGTACACCGGCTGG<br>GGCCGGCTGTCCCGGAAGCTGATCAACGGCATCCGGGACAAGCAGTCCGGCAAGAC-<br>CATCCTGGACTTCCTGAAGTCCGACGGCTTCGCCAACC | 150 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| fusion protein coding sequence) | GGAACTTCATGCAGCTGATCCACGACGACTCCTGACCTTCAAGGAGGA-<br>CATCCAGAAGGCCCAGGTGTCCGGCCAGGGCGACTCCCTGCACGA<br>GCACATCGCCAACCTGGCCGGCTCCCCCGCCATCAAGAAGGGCATCCTGCAGACCGT-<br>GAAGGTGGTGGACGAGCTGGTGAAGGTGATGGGCCGG<br>CACAAGCCCGAGAACATCGTGATCGAGATGGCCCGGGAGAACCAGAC-<br>CACCCAGAAGGGCCAGAAGAACTCCCGGGAGCGGATGAAGCGGATCG<br>AGGAGGGCATCAAGGAGCTGGGCTCCCAGATCCTGAAGGAGCACCCCGTG-<br>GAGAACACCCAGCTGCAGAACGAGAAGCTGTACCTGTACTACCT<br>GCAGAACGGCCGGGACATGTACGTGGACCAGGAGCTGGACATCAACCGGCTGTCCGAC-<br>TACGACGTGGACCACATCGTGCCCCAGTCCTTCCTG<br>AAGGACGACTC-<br>CATCGACAACAAGGTGCTGACCCGGTCCGACAAGAACCGGGGCAAGTCCGACAACGTGCCCTCCGAGGAGGTGGTGAAGAAGA<br>TGAAGAACTACTGGCGGCAGCTGCTGAACGCCAAGCTGATCACCCAGCG-<br>GAAGTTCGACAACCTGACCAAGGCCGAGCGGGGCGGCCTGTCCGA<br>GCTGGACAAGGCCGGCTTCATCAAGCGGCAGCTGGTGGAGACCCGGCAGATCAC-<br>CAAGCACGTGGCCCAGATCCTGGACTCCCGGATGAACACC<br>AAGTACGACGAGAACGACAAGCTGATCCGGGAGGTGAAGGTGATCACCCTGAAGTC-<br>CAAGCTGGTGTCCGACTTCCGGAAGGACTTCCAGTTCT<br>ACAAGGTGCGGGAGATCAACAACTACCACCACGCCCACGACGCCTACCT-<br>GAACGCCGTGGTGGGCACCGCCCTGATCAAGAAGTACCCCAAGCT<br>GGAGTCCGAGTTCGTGTACGGCGACTACAAGGTGTACGACGTGCGGAAGATGATCGC-<br>CAAGTCCGAGCAGGAGATCGGCAAGGCCACCGCCAAG<br>TACTTCTTCTACTCCAACATCATGAACTTCTTCAAGACCGAGATCACCCTGGC-<br>CAACGGCGAGATCCGGAAGCGGCCCCTGATCGAGACCAACG<br>GCGAGACCGGCGAGATCGTGTGGGACAAGGGCCGGGACTTCGCCACCGTGCG-<br>GAAGGTGCTGTCCATGCCCCAGGTGAACATCGTGAAGAAGAC<br>CGAGGTGCAGACCGGCGGCTTCTCCAAGGAGTCCATCCTGCCCAAGCG-<br>GAACTCCGACAAGCTGATCGCCCGGAAGAAGGACTGGGACCCCAAG<br>AAGTACGGCGGCTTCGACTCCCCCACCGTGGCCTACTCCGTGCTGGTGGTGGCCAAGGTG-<br>GAGAAGGGCAAGTCCAAGAAGCTGAAGTCCGTGA<br>AGGAGCTGCTGGGCATCACCATCATGGAGCGGTCCTCCTTCGAGAAGAACCC-<br>CATCGACTTCCTGGAGGCCAAGGGCTACAAGGAGGTGAAGAA<br>GGACCTGATCATCAAGCTGCCCAAGTACTCCCTGTTCGAGCTGGAGAACGGCCGGAAGCG-<br>GATGCTGGCCTCCGCCGGCGAGCTGCAGAAGGGC<br>AACGAGCTGGCCCTGCCCTCCAAGTACGTGAACTTCCTGTACCTGGCCTCCCAC-<br>TACGAGAAGCTGAAGGGCTCCCCCGAGGACAACGAGCAGA<br>AGCAGCTGTTCGTGGAGCAGCACAAGCACTACCTGGACGAGATCATCGAGCA-<br>GATCTCCGAGTTCTCCAAGCGGGTGATCCTGGCCGACGCCAA<br>CCTGGACAAGGTGCTGTCCGCCTACAACAAGCACCGGGACAAGCCCATCCGG-<br>GAGCAGGCCGAGAACATCATCCACCTGTTCACCCTGACCAAC<br>CTGGGCGCCCCCGCCGCCTTCAAGTACTTCGACACCACCATCGACCGGAAGCGGTA-<br>CACCTCCACCAAGGAGGTGCTGGACGCCACCCTGATCC<br>ACCAGTCCATCACCGGCCTGTACGAGACCCGGATCGACCTGTCCCAGCTGGGCGGCGAC | |
| Cas9 nickase ORF using low A codons of Table 4, with two C-terminal NLS se- | GACAAGAAGTACTCCATCGGCCTGGCCATCGGCACCAACTCCGTGGGCTGGGCCGTGAT-<br>CACCGACGAGTACAAGGTGCCCTCCAAGAAGTTCA<br>AGGTGCTGGGCAACACCGACCGGCACTCCATCAAGAAGAACCT-<br>GATCGGCGCCCTGCTGTTCGACTCCGGCGAGACCGCCGAGGCCACCCGGCT<br>GAAGCGGACCGCCCGGCGGCGGTACACCCGGCGGAAGAACCGGATCTGCTACCTGCAG-<br>GAGATCTTCTCCAACGAGATGGCCAAGGTGGACGAC<br>TCCTTCTTCCACCGGCTGGAGGAGTCCTTCCTGGTGGAG-<br>GAGGACAAGAAGCACGAGCGGCACCCCATCTTCGGCAACATCGTGGACGAGGTGG<br>CCTACCACGAGAAGTACCCCACCATCTACCACCTGCGGAAGAAGCTGGTGGACTC-<br>CACCGACAAGGCCGACCTGCGGCTGATCTACCTGGCCCT<br>GGCCCACATGATCAAGTTCCGGGGCCACTTCCTGATCGAGGGCGACCT-<br>GAACCCCGACAACTCCGACGTGGACAAGCTGTTCATCCAGCTGGTG<br>CAGACCTACAACCAGCTGTTCGAGGAGAACCCCATCAACGCCTCCGGCGTGGACGC-<br>CAAGGCCATCCTGTCCGCCCGGCTGTCCAAGTCCCGGC<br>GGCTGGAGAACCT-<br>GATCGCCCAGCTGCCCGGCGAGAAGAAGAACGGCCTGTTCGGCAACCTGATCGCCCTGTCCCTGGGCCTGACCCCCAACTT<br>CAAGTCCAACTTCGACCTGGCCGAGGACGCCAAGCTGCAGCTGTCCAAGGACACC-<br>TACGACGACGACCTGGACAACCTGCTGGCCCAGATCGGC<br>GACCAGTACGCCGACCTGTTCCTGGCCGCCAAGAACCTGTCCGACGC-<br>CATCCTGCTGTCCGACATCCTGCGGGTGAACACCGAGATCACCAAGG<br>CCCCCCTGTCCGCCTCCATGATCAAGCGGTACGACGAGCAC-<br>CACCAGGACCTGACCCTGCTGAAGGCCCTGGTGCGGCAGCAGCTGCCCGAGAA<br>GTACAAGGAGATCTTCTTCGACCAGTCCAAGAACGGCTACGCCGGCTA-<br>CATCGACGGCGGCGCCTCCCAGGAGGAGTTCTACAAGTTCATCAAG<br>CCCATCCTGGAGAAGATGGACGGCACCGAGGAGCTGCTGGTGAAGCTGAACCGG-<br>GAGGACCTGCTGCGGAAGCAGCGGACCTTCGACAACGGCT<br>CCATCCCCCACCAGATCCACCTGGGCGAGCTGCACGCCATCCTGCGGCGGCAG-<br>GAGGACTTCTACCCCTTCCTGAAGGACAACCGGGAGAAGAT<br>CGAGAAGATCCTGACCTTCCGGATCCCCTAC-<br>TACGTGGGCCCCCTGGCCCGGGGCAACTCCCGGTTCGCCTGGATGACCCGGAAGTCCGAGGAG<br>ACCATCACCCCCTGGAACTTCGAGGAGGTGGTGGACAAGGGCGCCTCCGCCCAGTCCTT-<br>CATCGAGCGGATGACCAACTTCGACAAGAACCTGC | 151 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| quences (no start or stop codons; suitable for inclusion in fusion protein coding sequence) | CCAACGAGAAGGTGCTGCCCAAGCACTCCCTGCTGTACGAGTACTTCACCGTGTA-CAACGAGCTGACCAAGGTGAAGTACGTGACCGAGGGCAT GCGGAAGCCCGCCTTCCTGTCCGGCGAGCAGAAGAAGGCCATCGTGGACCTGCTGTTCAA-GACCAACCGGAAGGTGACCGTGAAGCAGCTGAAG GAGGACTACTTCAAGAAGATCGAGTGCTTCGACTCCGTGGAGATCTCCGGCGTG-GAGGACCGGTTCAACGCCTCCCTGGGCACCTACCACGACC TGCTGAAGATCATCAAGGACAAGGACTTCCTGGACAACGAGGAGAACGAGGACATCCTG-GAGGACATCGTGCTGACCCTGACCCTGTTCGAGGA CCGGGAGATGATCGAGGAGCGGCTGAAGACCTACGCCCACCTGTTCGACGACAAGGTGAT-GAAGCAGCTGAAGCGGCGGCGGTACACCGGCTGG GGCCGGCTGTCCCGGAAGCTGATCAACGGCATCCGGGACAAGCAGTCCGGCAAGAC-CATCCTGGACTTCCTGAAGTCCGACGGCTTCGCCAACC GGAACTTCATGCAGCTGATCCACGACGACTCCCTGACCTTCAAGGAGGA-CATCCAGAAGGCCCAGGTGTCCGGCCAGGGCGACTCCCTGCACGA GCACATCGCCAACCTGGCCGGCTCCCCCGCCATCAAGAAGGGCATCCTGCAGACCGT-GAAGGTGGTGGACGAGCTGGTGAAGGTGATGGGCCGG CACAAGCCCGAGAACATCGTGATCGAGATGGCCCGGGAGAACCAGAC-CACCCAGAAGGGCCAGAAGAACTCCCGGGAGCGGATGAAGCGGATCG AGGAGGGCATCAAGGAGCTGGGCTCCCAGATCCTGAAGGAGCACCCCGTG-GAGAACACCCAGCTGCAGAACGAGAAGCTGTACCTGTACTACCT GCAGAACGGCCGGGACATGTACGTGGACCAGGAGCTGGACATCAACCGGCTGTCCGAC-TACGACGTGGACCACATCGTGCCCCAGTCCTTCCTG AAGGACGACTC-CATCGACAACAAGGTGCTGACCCGGTCCGACAAGAACCGGGGCAAGTCCGACAACGTGCCCTCCGAGGAGGTGGTGAAGAAGA TGAAGAACTACTGGCGGCAGCTGCTGAACGCCAAGCTGATCACCCAGCG-GAAGTTCGACAACCTGACCAAGGCCGAGCGGGGCGGCCTGTCCGA GCTGGACAAGGCCGGCTTCATCAAGCGGCAGCTGGTGGAGACCCGGCAGATCAC-CAAGCACGTGGCCCAGATCCTGGACTCCCGGATGAACACC AAGTACGACGAGAACGACAAGCTGATCCGGGAGGTGAAGGTGATCACCCTGAAGTC-CAAGCTGGTGTCCGACTTCCGGAAGGACTTCCAGTTCT ACAAGGTGCGGGAGATCAACAACTACCACCACGCCCACGACGCCTACCT-GAACGCCGTGGTGGGCACCGCCCTGATCAAGAAGTACCCCAAGCT GGAGTCCGAGTTCGTGTACGGCGACTACAAGGTGTACGACGTGCGGAAGATGATCGC-CAAGTCCGAGCAGGAGATCGGCAAGGCCACCGCCAAG TACTTCTTCTACTCCAACATCATGAACTTCTTCAAGACCGAGATCACCCTGGC-CAACGGCGAGATCCGGAAGCGGCCCCTGATCGAGACCAACG GCGAGACCGGCGAGATCGTGTGGGACAAGGGCCGGGACTTCGCCACCGTGCG-GAAGGTGCTGTCCATGCCCCAGGTGAACATCGTGAAGAAGAC CGAGGTGCAGACCGGCGGCTTCTCCAAGGAGTCCATCCTGCCCAAGCG-GAACTCCGACAAGCTGATCGCCCGGAAGAAGGACTGGGACCCCAAG AAGTACGGCGGCTTCGACTCCCCCACCGTGGCCTACTCCGTGCTGGTGGTGGCCAAGGTG-GAGAAGGGCAAGTCCAAGAAGCTGAAGTCCGTGA AGGAGCTGCTGGGCATCACCATCATGGAGCGGTCCTCCTTCGAGAAGAACCC-CATCGACTTCCTGGAGGCCAAGGGCTACAAGGAGGTGAAGAA GGACCTGATCATCAAGCTGCCCAAGTACTCCCTGTTCGAGCTGGAGAACGGCCGGAAGCG-GATGCTGGCCTCCGCCGGCGAGCTGCAGAAGGGC AACGAGCTGGCCCTGCCCTCCAAGTACGTGAACTTCCTGTACCTGGCCTCCCAC-TACGAGAAGCTGAAGGGCTCCCCCGAGGACAACGAGCAGA AGCAGCTGTTCGTGGAGCAGCACAAGCACTACCTGGACGAGATCATCGAGCA-GATCTCCGAGTTCTCCAAGCGGGTGATCCTGGCCGACGCCAA CCTGGACAAGGTGCTGTCCGCCTACAACAAGCACCGGGACAAGCCCATCCGG-GAGCAGGCCGAGAACATCATCCACCTGTTCACCCTGACCAAC CTGGGCGCCCCCGCCGCCTTCAAGTACTTCGACACCACCATCGACCGGAAGCGGTA-CACCTCCACCAAGGAGGTGCTGGACGCCACCCTGATCC ACCAGTCCATCACCGGCCTGTACGAGACCCG-GATCGACCTGTCCCAGCTGGGCGGCGACGGCTCCGGCTCCCCCAAGAAGAAGCGGAAGGTGGA CGGCTCCCCCAAGAAGAAGCGGAAGGTGGACTCCGGC | |
| dCas9 ORF using low A codons of Table 4 (no start | GACAAGAAGTACTCCATCGGCCTGGCCATCGGCACCAACTCCGTGGGCTGGGCCGTGAT-CACCGACGAGTACAAGGTGCCCTCCAAGAAGTTCA AGGTGCTGGGCAACACCGACCGGCACTCCATCAAGAAGAACCT-GATCGGCGCCCTGCTGTTCGACTCCGGCGAGACCGCCGAGGCCACCCGGCT GAAGCGGACCGCCCGGCGGCGGTACACCCGGCGGAAGAACCGGATCTGCTACCTGCAG-GAGATCTTCTCCAACGAGATGGCCAAGGTGGACGAC TCCTTCTTCCACCGGCTGGAGGAGTCCTTCCTGGTGGAG-GAGGACAAGAAGCACGAGCGGCACCCCATCTTCGGCAACATCGTGGACGAGGTGG CCTACCACGAGAAGTACCCCACCATCTACCACCTGCGGAAGAAGCTGGTGGACTC-CACCGACAAGGCCGACCTGCGGCTGATCTACCTGGCCCT GGCCCACATGATCAAGTTCCGGGGCCACTTCCTGATCGAGGGCGACCT-GAACCCCGACAACTCCGACGTGGACAAGCTGTTCATCCAGCTGGTG CAGACCTACAACCAGCTGTTCGAGGAGAACCCCATCAACGCCTCCGGCGTGGACGC-CAAGGCCATCCTGTCCGCCCGGCTGTCCAAGTCCCGGC GGCTGGAGAACCT-GATCGCCCAGCTGCCCGGCGAGAAGAAGAACGGCCTGTTCGGCAACCTGATCGCCCTGTCCCTGGGCCTGACCCCCAACTT CAAGTCCAACTTCGACCTGGCCGAGGACGCCAAGCTGCAGCTGTCCAAGGACACC-TACGACGACGACCTGGACAACCTGCTGGCCCAGATCGGC | 152 |

-continued

Sequence Table
The following sequence table provides a listing of sequences disclosed herein. It is understood that if a DNA sequence (comprising Ts) is referenced with respect to an RNA, then Ts should be replaced with Us(which may be modified or unmodified depending on the context), and vice versa.

| Description | Sequence | SEQ ID No. |
|---|---|---|
| or stop codons; suitable for inclusion in fusion protein coding sequence) | GACCAGTACGCCGACCTGTTCCTGGCCGCCAAGAACCTGTCCGACGC-CATCCTGCTGTCCGACATCCTGCGGGTGAACACCGAGATCACCAAGG CCCCCCTGTCCGCCTCCATGATCAAGCGGTACGACGAGCAC-CACCAGGACCTGACCCTGCTGAAGGCCCTGGTGCGGCAGCAGCTGCCCGAGAA GTACAAGGAGATCTTCTTCGACCAGTCCAAGAACGGCTACGCCGGCTA-CATCGACGGCGGCGCCTCCCAGGAGGAGTTCTACAAGTTCATCAAG CCCATCCTGGAGAAGATGGACGGCACCGAGGAGCTGCTGGTGAAGCTGAACCGG-GAGGACCTGCTGCGGAAGCAGCGGACCTTCGACAACGGCT CCATCCCCCACCAGATCCACCTGGGCGAGCTGCACGCCATCCTGCGGCGGCAG-GAGGACTTCTACCCCTTCCTGAAGGACAACCGGGAGAAGAT CGAGAAGATCCTGACCTTCCGGATCCCCTAC-TACGTGGGCCCCCTGGCCCGGGGCAACTCCCGGTTCGCCTGGATGACCCGGAAGTCCGAGGAG ACCATCACCCCCTGGAACTTCGAGGAGGTGGTGGACAAGGGCGCCTCCGCCCAGTCCTT-CATCGAGCGGATGACCAACTTCGACAAGAACCTGC CCAACGAGAAGGTGCTGCCCAAGCACTCCCTGCTGTACGAGTACTTCACCGTGTA-CAACGAGCTGACCAAGGTGAAGTACGTGACCGAGGGCAT GCGGAAGCCCGCCTTCCTGTCCGGCGAGCAGAAGAAGGCCATCGTGGACCTGCTGTTCAA-GACCAACCGGAAGGTGACCGTGAAGCAGCTGAAG GAGGACTACTTCAAGAAGATCGAGTGCTTCGACTCCGTGGAGATCTCCGGCGTG-GAGGACCGGTTCAACGCCTCCCTGGGCACCTACCACGACC TGCTGAAGATCATCAAGGACAAGGACTTCCTGGACAACGAGGAGAACGAGGACATCCTG-GAGGACATCGTGCTGACCCTGACCCTGTTCGAGGA CCGGGAGATGATCGAGGAGCGGCTGAAGACCTACGCCCACCTGTTCGACGACAAGGTGAT-GAAGCAGCTGAAGCGGCGGCGGTACACCGGCTGG GGCCGGCTGTCCCGGAAGCTGATCAACGGCATCCGGGACAAGCAGTCCGGCAAGAC-CATCCTGGACTTCCTGAAGTCCGACGGCTTCGCCAACC GGAACTTCATGCAGCTGATCCACGACGACTCCCTGACCTTCAAGGAGGA-CATCCAGAAGGCCCAGGTGTCCGGCCAGGGCGACTCCCTGCACGA GCACATCGCCAACCTGGCCGGCTCCCCCGCCATCAAGAAGGGCATCCTGCAGACCGT-GAAGGTGGTGGACGAGCTGGTGAAGGTGATGGGCCGG CACAAGCCCGAGAACATCGTGATCGAGATGGCCCGGGAGAACCAGAC-CACCCAGAAGGGCCAGAAGAACTCCCGGGAGCGGATGAAGCGGATCG AGGAGGGCATCAAGGAGCTGGGCTCCCAGATCCTGAAGGAGCACCCCGTG-GAGAACACCCAGCTGCAGAACGAGAAGCTGTACCTGTACTACCT GCAGAACGGCCGGGACATGTACGTGGACCAGGAGCTGGACATCAACCGGCTGTCCGAC-TACGACGTGGACGCCATCGTGCCCCAGTCCTTCCTG AAGGACGACTC-CATCGACAACAAGGTGCTGACCCGGTCCGACAAGAACCGGGGCAAGTCCGACAACGTGCCCTCCGAGGAGGTGGTGAAGAAGA TGAAGAACTACTGGCGGCAGCTGCTGAACGCCAAGCTGATCACCCAGCG-GAAGTTCGACAACCTGACCAAGGCCGAGCGGGGCGGCCTGTCCGA GCTGGACAAGGCCGGCTTCATCAAGCGGCAGCTGGTGGAGACCCGGCAGATCAC-CAAGCACGTGGCCCAGATCCTGGACTCCCGGATGAACACC AAGTACGACGAGAACGACAAGCTGATCCGGGAGGTGAAGGTGATCACCCTGAAGTC-CAAGCTGGTGTCCGACTTCCGGAAGGACTTCCAGTTCT ACAAGGTGCGGGAGATCAACAACTACCACCACGCCCACGACGCCTACCT-GAACGCCGTGGTGGGCACCGCCCTGATCAAGAAGTACCCCAAGCT GGAGTCCGAGTTCGTGTACGGCGACTACAAGGTGTACGACGTGCGGAAGATGATCGC-CAAGTCCGAGCAGGAGATCGGCAAGGCCACCGCCAAG TACTTCTTCTACTCCAACATCATGAACTTCTTCAAGACCGAGATCACCCTGGC-CAACGGCGAGATCCGGAAGCGGCCCCTGATCGAGACCAACG GCGAGACCGGCGAGATCGTGTGGGACAAGGGCCGGGACTTCGCCACCGTGCG-GAAGGTGCTGTCCATGCCCCAGGTGAACATCGTGAAGAAGAC CGAGGTGCAGACCGGCGGCTTCTCCAAGGAGTCCATCCTGCCCAAGCG-GAACTCCGACAAGCTGATCGCCCGGAAGAAGGACTGGGACCCCAAG AAGTACGGCGGCTTCGACTCCCCCACCGTGGCCTACTCCGTGCTGGTGGTGGCCAAGGTG-GAGAAGGGCAAGTCCAAGAAGCTGAAGTCCGTGA AGGAGCTGCTGGGCATCACCATCATGGAGCGGTCCTCCTTCGAGAAGAACCC-CATCGACTTCCTGGAGGCCAAGGGCTACAAGGAGGTGAAGAA GGACCTGATCATCAAGCTGCCCAAGTACTCCCTGTTCGAGCTGGAGAACGGCCGGAAGCG-GATGCTGGCCTCCGCCGGCGAGCTGCAGAAGGGC AACGAGCTGGCCCTGCCCTCCAAGTACGTGAACTTCCTGTACCTGGCCTCCCAC-TACGAGAAGCTGAAGGGCTCCCCCGAGGACAACGAGCAGA AGCAGCTGTTCGTGGAGCAGCACAAGCACTACCTGGACGAGATCATCGAGCA-GATCTCCGAGTTCTCCAAGCGGGTGATCCTGGCCGACGCCAA CCTGGACAAGGTGCTGTCCGCCTACAACAAGCACCGGGACAAGCCCATCCGG-GAGCAGGCCGAGAACATCATCCACCTGTTCACCCTGACCAAC CTGGGCGCCCCCGCCGCCTTCAAGTACTTCGACACCACCATCGACCGGAAGCGGTA-CACCTCCACCAAGGAGGTGCTGGACGCCACCCTGATCC ACCAGTCCATCACCGGCCTGTACGAGACCCG-GATCGACCTGTCCCAGCTGGGCGGCGACGGCGGCGGCTCCCCCAAGAAGAAGCGGAAGGTG | |
| dCas9 ORF | GACAAGAAGTACTCCATCGGCCTGGCCATCGGCACCAACTCCGTGGGCTGGGCCGTGAT-CACCGACGAGTACAAGGTGCCCTCCAAGAAGTTCA AGGTGCTGGGCAACACCGACCGGCACTCCATCAAGAAGAACCT-GATCGGCGCCCTGCTGTTCGACTCCGGCGAGACCGCCGAGGCCACCCGGCT | 153 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| using low A codons of Table 4 (no NLS and no start or stop codons; suitable for inclusion in fusion protein coding sequence) | GAAGCGGACCGCCCGGCGGCGGTACACCCGGCGGAAGAACCGGATCTGCTACCTGCAG-GAGATCTTCTCCAACGAGATGGCCAAGGTGGACGAC TCCTTCTTCCACCGGCTGGAGGAGTCCTTCCTGGTGGAG-GAGGACAAGAAGCACGAGCGGCACCCCATCTTCGGCAACATCGTGGACGAGGTGG CCTACCACGAGAAGTACCCCACCATCTACCACCTGCGGAAGAAGCTGGTGGACTC-CACCGACAAGGCCGACCTGCGGCTGATCTACCTGGCCCT GGCCCACATGATCAAGTTCCGGGGCCACTTCCTGATCGAGGGCGACCT-GAACCCCGACAACTCCGACGTGGACAAGCTGTTCATCCAGCTGGTG CAGACCTACAACCAGCTGTTCGAGGAGAACCCCATCAACGCCTCCGGCGTGGACGC-CAAGGCCATCCTGTCCGCCCGGCTGTCCAAGTCCCGGC GGCTGGAGAACCT-GATCGCCCAGCTGCCCGGCGAGAAGAAGAACGGCCTGTTCGGCAACCTGATCGCCCTGTCCCTGGGCCTGACCCCCAACTT CAAGTCCAACTTCGACCTGGCCGAGGACGCCAAGCTGCAGCTGTCCAAGGACACC-TACGACGACGACCTGGACAACCTGCTGGCCCAGATCGGC GACCAGTACGCCGACCTGTTCCTGGCCGCCAAGAACCTGTCCGACGC-CATCCTGCTGTCCGACATCCTGCGGGTGAACACCGAGATCACCAAGG CCCCCCTGTCCGCCTCCATGATCAAGCGGTACGACGAGCAC-CACCAGGACCTGACCCTGCTGAAGGCCCTGGTGCGGCAGCAGCTGCCCGAGAA GTACAAGGAGATCTTCTTCGACCAGTCCAAGAACGGCTACGCCGGCTA-CATCGACGGCGGCGCCTCCCAGGAGGAGTTCTACAAGTTCATCAAG CCCATCCTGGAGAAGATGGACGGCACCGAGGAGCTGCTGGTGAAGCTGAACCGG-GAGGACCTGCTGCGGAAGCAGCGGACCTTCGACAACGGCT CCATCCCCCACCAGATCCACCTGGGCGAGCTGCACGCCATCCTGCGGCGGCAG-GAGGACTTCTACCCCTTCCTGAAGGACAACCGGGAGAAGAT CGAGAAGATCCTGACCTTCCGGATCCCCTAC-TACGTGGGCCCCCTGGCCCGGGGCAACTCCCGGTTCGCCTGGATGACCCGGAAGTCCGAGGAG ACCATCACCCCCTGGAACTTCGAGGAGGTGGTGGACAAGGGCGCCTCCGCCCAGTCCTT-CATCGAGCGGATGACCAACTTCGACAAGAACCTGC CCAACGAGAAGGTGCTGCCCAAGCACTCCCTGCTGTACGAGTACTTCACCGTGTA-CAACGAGCTGACCAAGGTGAAGTACGTGACCGAGGGCAT GCGGAAGCCCGCCTTCCTGTCCGGCGAGCAGAAGAAGGCCATCGTGGACCTGCTGTTCAA-GACCAACCGGAAGGTGACCGTGAAGCAGCTGAAG GAGGACTACTTCAAGAAGATCGAGTGCTTCGACTCCGTGGAGATCTCCGGCGTG-GAGGACCGGTTCAACGCCTCCCTGGGCACCTACCACGACC TGCTGAAGATCATCAAGGACAAGGACTTCCTGGACAACGAGGAGAACGAGGACATCCTG-GAGGACATCGTGCTGACCCTGACCCTGTTCGAGGA CCGGGAGATGATCGAGGAGCGGCTGAAGACCTACGCCCACCTGTTCGACGACAAGGTGAT-GAAGCAGCTGAAGCGGCGGCGGTACACCGGCTGG GGCCGGCTGTCCCGGAAGCTGATCAACGGCATCCGGGACAAGCAGTCCGGCAAGAC-CATCCTGGACTTCCTGAAGTCCGACGGCTTCGCCAACC GGAACTTCATGCAGCTGATCCACGACGACTCCCTGACCTTCAAGGAGGA-CATCCAGAAGGCCCAGGTGTCCGGCCAGGGCGACTCCCTGCACGA GCACATCGCCAACCTGGCCGGCTCCCCCGCCATCAAGAAGGGCATCCTGCAGACCGT-GAAGGTGGTGGACGAGCTGGTGAAGGTGATGGGCCGG CACAAGCCCGAGAACATCGTGATCGAGATGGCCCGGGAGAACCAGAC-CACCCAGAAGGGCCAGAAGAACTCCCGGGAGCGGATGAAGCGGATCG AGGAGGGCATCAAGGAGCTGGGCTCCCAGATCCTGAAGGAGCACCCCGTG-GAGAACACCCAGCTGCAGAACGAGAAGCTGTACCTGTACTACCT GCAGAACGGCCGGGACATGTACGTGGACCAGGAGCTGGACATCAACCGGCTGTCCGAC-TACGACGTGGACGCCATCGTGCCCCAGTCCTTCCTG AAGGACGACTC-CATCGACAACAAGGTGCTGACCCGGTCCGACAAGAACCGGGGCAAGTCCGACAACGTGCCCTCCGAGGAGGTGGTGAAGAAGA TGAAGAACTACTGGCGGCAGCTGCTGAACGCCAAGCTGATCACCCAGCG-GAAGTTCGACAACCTGACCAAGGCCGAGCGGGGCGGCCTGTCCGA GCTGGACAAGGCCGGCTTCATCAAGCGGCAGCTGGTGGAGACCCGGCAGATCAC-CAAGCACGTGGCCCAGATCCTGGACTCCCGGATGAACACC AAGTACGACGAGAACGACAAGCTGATCCGGGAGGTGAAGGTGATCACCCTGAAGTC-CAAGCTGGTGTCCGACTTCCGGAAGGACTTCCAGTTCT ACAAGGTGCGGGAGATCAACAACTACCACCACGCCCACGACGCCTACCT-GAACGCCGTGGTGGGCACCGCCCTGATCAAGAAGTACCCCAAGCT GGAGTCCGAGTTCGTGTACGGCGACTACAAGGTGTACGACGTGCGGAAGATGATCGC-CAAGTCCGAGCAGGAGATCGGCAAGGCCACCGCCAAG TACTTCTTCTACTCCAACATCATGAACTTCTTCAAGACCGAGATCACCCTGGC-CAACGGCGAGATCCGGAAGCGGCCCCTGATCGAGACCAACG GCGAGACCGGCGAGATCGTGTGGGACAAGGGCCGGGACTTCGCCACCGTGCG-GAAGGTGCTGTCCATGCCCCAGGTGAACATCGTGAAGAAGAC CGAGGTGCAGACCGGCGGCTTCTCCAAGGAGTCCATCCTGCCCAAGCG-GAACTCCGACAAGCTGATCGCCCGGAAGAAGGACTGGGACCCCAAG AAGTACGGCGGCTTCGACTCCCCCACCGTGGCCTACTCCGTGCTGGTGGTGGCCAAGGTG-GAGAAGGGCAAGTCCAAGAAGCTGAAGTCCGTGA AGGAGCTGCTGGGCATCACCATCATGGAGCGGTCCTCCTTCGAGAAGAACCC-CATCGACTTCCTGGAGGCCAAGGGCTACAAGGAGGTGAAGAA GGACCTGATCATCAAGCTGCCCAAGTACTCCCTGTTCGAGCTGGAGAACGGCCGGAAGCG-GATGCTGGCCTCCGCCGGCGAGCTGCAGAAGGGC AACGAGCTGGCCCTGCCCTCCAAGTACGTGAACTTCCTGTACCTGGCCTCCCAC-TACGAGAAGCTGAAGGGCTCCCCCGAGGACAACGAGCAGA | |

| Description | Sequence | SEQ ID No. |
|---|---|---|
| | AGCAGCTGTTCGTGGAGCAGCACAAGCACTACCTGGACGAGATCATCGAGCA-<br>GATCTCCGAGTTCTCCAAGCGGGTGATCCTGGCCGACGCCAA<br>CCTGGACAAGGTGCTGTCCGCCTACAACAAGCACGGGACAAGCCCATCCGG-<br>GAGCAGGCCGAGAACATCATCCACCTGTTCACCCTGACCAAC<br>CTGGGCGCCCCCGCCGCCTTCAAGTACTTCGACACCACCATCGACCGGAAGCGGTA-<br>CACCTCCACCAAGGAGGTGCTGGACGCCACCCTGATCC<br>ACCAGTCCATCACCGGCCTGTACGAGACCCGGATCGACCTGTCCCAGCTGGGCGGCGAC | |
| dCas9 ORF using low A codons of Table 4, with two C-terminal NLS sequences (no start or stop codons; suitable for inclusion in fusion protein coding sequence) | GACAAGAAGTACTCCATCGGCCTGGCCATCGGCACCAACTCCGTGGGCTGGGCCGTGAT-<br>CACCGACGAGTACAAGGTGCCCTCCAAGAAGTTCA<br>AGGTGCTGGGCAACACCGACCGGCACTCCATCAAGAAGAACCT-<br>GATCGGCGCCCTGCTGTTCGACTCCGGCGAGACCGCCGAGGCCACCCGGCT<br>GAAGCGGACCGCCCGGCGGCGGTACACCCGGCGGAAGAACCGGATCTGCTACCTGCAG-<br>GAGATCTTCTCCAACGAGATGGCCAAGGTGGACGAC<br>TCCTTCTTCCACCGGCTGGAGGAGTCCTTCCTGGTGGAG-<br>GAGGACAAGAAGCACGAGCGGCACCCCATCTTCGGCAACATCGTGGACGAGGTGG<br>CCTACCACGAGAAGTACCCCACCATCTACCACCTGCGGAAGAAGCTGGTGGACTC-<br>CACCGACAAGGCCGACCTGCGGCTGATCTACCTGGCCCT<br>GGCCCACATGATCAAGTTCCGGGGCCACTTCCTGATCGAGGGCGACCT-<br>GAACCCCGACAACTCCGACGTGGACAAGCTGTTCATCCAGCTGGTG<br>CAGACCTACAACCAGCTGTTCGAGGAGAACCCCATCAACGCCTCCGGCGTGGACGC-<br>CAAGGCCATCCTGTCCGCCCGGCTGTCCAAGTCCCGGC<br>GGCTGGAGAACCT-<br>GATCGCCCAGCTGCCCGGCGAGAAGAAGAACGGCCTGTTCGGCAACCTGATCGCCCTGTCCCTGGGCCTGACCCCCAACTT<br>CAAGTCCAACTTCGACCTGGCCGAGGACGCCAAGCTGCAGCTGTCCAAGGACACC-<br>TACGACGACGACCTGGACAACCTGCTGGCCCAGATCGGC<br>GACCAGTACGCCGACCTGTTCCTGGCCGCCAAGAACCTGTCCGACGC-<br>CATCCTGCTGTCCGACATCCTGCGGGTGAACACCGAGATCACCAAGG<br>CCCCCCTGTCCGCCTCCATGATCAAGCGGTACGACGAGCAC-<br>CACCAGGACCTGACCCTGCTGAAGGCCCTGGTGCGGCAGCAGCTGCCCGAGAA<br>GTACAAGGAGATCTTCTTCGACCAGTCCAAGAACGGCTACGCCGGCTA-<br>CATCGACGGCGGCGCCTCCCAGGAGGAGTTCTACAAGTTCATCAAG<br>CCCATCCTGGAGAAGATGGACGGCACCGAGGAGCTGCTGGTGAAGCTGAACCGG-<br>GAGGACCTGCTGCGGAAGCAGCGGACCTTCGACAACGGCT<br>CCATCCCCCACCAGATCCACCTGGGCGAGCTGCACGCCATCCTGCGGCGGCAG-<br>GAGGACTTCTACCCCTTCCTGAAGGACAACGGGAGAAGAT<br>CGAGAAGATCCTGACCTTCCGGATCCCCTAC-<br>TACGTGGGCCCCCTGGCCCGGGGCAACTCCCGGTTCGCCTGGATGACCCGGAAGTCCGAGGAG<br>ACCATCACCCCCTGGAACTTCGAGGAGGTGGTGGACAAGGGCGCCTCCGCCCAGTCCTT-<br>CATCGAGCGGATGACCAACTTCGACAAGAACCTGC<br>CCAACGAGAAGGTGCTGCCCAAGCACTCCCTGCTGTACGAGTACTTCACCGTGTA-<br>CAACGAGCTGACCAAGGTGAAGTACGTGACCGAGGGCAT<br>GCGGAAGCCCGCCTTCCTGTCCGGCGAGCAGAAGAAGGCCATCGTGGACCTGCTGTTCAA-<br>GACCAACCGGAAGGTGACCGTGAAGCAGCTGAAG<br>GAGGACTACTTCAAGAAGATCGAGTGCTTCGACTCCGTGGAGATCTCCGGCGTG-<br>GAGGACCGGTTCAACGCCTCCCTGGGCACCTACCACGACC<br>TGCTGAAGATCATCAAGGACAAGGACTTCCTGGACAACGAGGAGAACGAGGACATCCTG-<br>GAGGACATCGTGCTGACCCTGACCCTGTTCGAGGA<br>CCGGGAGATGATCGAGGAGCGGCTGAAGACCTACGCCCACCTGTTCGACGACAAGGTGAT-<br>GAAGCAGCTGAAGCGGCGGCGGTACACCGGCTGG<br>GGCCGGCTGTCCCGGAAGCTGATCAACGGCATCCGGGACAAGCAGTCCGGCAAGAC-<br>CATCCTGGACTTCCTGAAGTCCGACGGCTTCGCCAACC<br>GGAACTTCATGCAGCTGATCCACGACGACTCCCTGACCTTCAAGGAGGA-<br>CATCCAGAAGGCCCAGGTGTCCGGCCAGGGCGACTCCCTGCACGA<br>GCACATCGCCAACCTGGCCGGCTCCCCCGCCATCAAGAAGGGCATCCTGCAGACCGT-<br>GAAGGTGGTGGACGAGCTGGTGAAGGTGATGGGCCGG<br>CACAAGCCCGAGAACATCGTGATCGAGATGGCCCGGGAGAACCAGAC-<br>CACCCAGAAGGGCCAGAAGAACTCCCGGGAGCGGATGAAGCGGATCG<br>AGGAGGGCATCAAGGAGCTGGGCTCCCAGATCCTGAAGGAGCACCCCGTG-<br>GAGAACACCCAGCTGCAGAACGAGAAGCTGTACCTGTACTACCT<br>GCAGAACGGCCGGGACATGTACGTGGACCAGGAGCTGGACATCAACCGGCTGTCCGAC-<br>TACGACGTGGACCATCGTGCCCCAGTCCTTCCTG<br>AAGGACGACTC-<br>CATCGACAACAAGGTGCTGACCCGGTCCGACAAGAACCGGGGCAAGTCCGACAACGTGCCCTCCGAGGAGGTGGTGAAGAAGA<br>TGAAGAACTACTGGCGGCAGCTGCTGAACGCCAAGCTGATCACCCAGCG-<br>GAAGTTCGACAACCTGACCAAGGCCGAGCGGGGCGGCCTGTCCGA<br>GCTGGACAAGGCCGGCTTCATCAAGCGGCAGCTGGTGGAGACCCGGCAGATCAC-<br>CAAGCACGTGGCCCAGATCCTGGACTCCCGGATGAACACC<br>AAGTACGACGAGAACGACAAGCTGATCCGGGAGGTGAAGGTGATCACCCTGAAGTC-<br>CAAGCTGGTGTCCGACTTCCGGAAGGACTTCCAGTTCT<br>ACAAGGTGCGGGAGATCAACAACTACCACCACGCCCACGACGCCTACCT-<br>GAACGCCGTGGTGGGCACCGCCCTGATCAAGAAGTACCCCAAGCT<br>GGAGTCCGAGTTCGTGTACGGCGACTACAAGGTGTACGACGTGCGGAAGATGATCGC-<br>CAAGTCCGAGCAGGAGATCGGCAAGGCCACCGCCAAG<br>TACTTCTTCTACTCCAACATCATGAACTTCTTCAAGACCGAGATCACCCTGGC-<br>CAACGGCGAGATCCGGAAGCGGCCCCTGATCGAGACCAACG | 154 |

| Description | Sequence | SEQ ID No. |
|---|---|---|
| | GCGAGACCGGCGAGATCGTGTGGGACAAGGGCCGGGACTTCGCCACCGTGCG-<br>GAAGGTGCTGTCCATGCCCCAGGTGAACATCGTGAAGAAGAC<br>CGAGGTGCAGACCGGCGGCTTCTCCAAGGAGTCCATCCTGCCCAAGCG-<br>GAACTCCGACAAGCTGATCGCCCGGAAGAAGGACTGGGACCCCAAG<br>AAGTACGGCGGCTTCGACTCCCCCACCGTGGCCTACTCCGTGCTGGTGGTGGCCAAGGTG-<br>GAGAAGGGCAAGTCCAAGAAGCTGAAGTCCGTGA<br>AGGAGCTGCTGGGCATCACCATCATGGAGCGGTCCTCCTTCGAGAAGAACCC-<br>CATCGACTTCCTGGAGGCCAAGGGCTACAAGGAGGTGAAGAA<br>GGACCTGATCATCAAGCTGCCCAAGTACTCCCTGTTCGAGCTGGAGAACGGCCGGAAGCG-<br>GATGCTGGCCTCCGCCGGCGAGCTGCAGAAGGGC<br>AACGAGCTGGCCCTGCCCTCCAAGTACGTGAACTTCCTGTACCTGGCCTCCCAC-<br>TACGAGAAGCTGAAGGGCTCCCCCGAGGACAACGAGCAGA<br>AGCAGCTGTTCGTGGAGCAGCACAAGCACTACCTGGACGAGATCATCGAGCA-<br>GATCTCCGAGTTCTCCAAGCGGGTGATCCTGGCCGACGCCAA<br>CCTGGACAAGGTGCTGTCCGCCTACAACAAGCACCGGGACAAGCCCATCCGG-<br>GAGCAGGCCGAGAACATCATCCACCTGTTCACCCTGACCAAC<br>CTGGGCGCCCCCGCCGCCTTCAAGTACTTCGACACCACCATCGACCGGAAGCGGTA-<br>CACCTCCACCAAGGAGGTGCTGGACGCCACCCTGATCC<br>ACCAGTCCATCACCGGCCTGTACGAGACCCG-<br>GATCGACCTGTCCCAGCTGGGCGGCGACGGCTCCGGCTCCCCCAAGAAGAAGCGGAAGGTGGA<br>CGGCTCCCCCAAGAAGAAGCGGAAGGTGGACTCCGGC | |
| Cas9 ORF using low A/U codons of Table 4, with two C-term- inal NLS se- quences (no start or stop codons; suit- able for inclu- sion in | GACAAGAAGTACAGCATCGGCCTGGACATCGGCACCAACAGCGTGGGCTGGGCCGTGAT-<br>CACCGACGAGTACAAGGTGCCCAGCAAGAAGTTCA<br>AGGTGCTGGGCAACACCGACCGGCACAGCATCAAGAAGAACCT-<br>GATCGGCGCCCTGCTGTTCGACAGCGGCGAGACCGCCGAGGCCACCCGGCT<br>GAAGCGGACCGCCCGGCGGCGGTACACCCGGCGGAAGAACCGGATCTGCTACCTGCAG-<br>GAGATCTTCAGCAACGAGATGGCCAAGGTGGACGAC<br>AGCTTCTTCCACCGGCTGGAGGAGAGCTTCCTGGTGGAG-<br>GAGGACAAGAAGCACGAGCGGCACCCCATCTTCGGCAACATCGTGGACGAGGTGG<br>CCTACCACGAGAAGTACCCCACCATCTACCACCTGCGC-<br>GAAGAAGCTGGTGGACAGCACCGACAAGGCCGACCTGCGGCTGATCTACCTGGCCCT<br>GGCCCACATGATCAAGTTCCGGGGCCACTTCCTGATCGAGGGCGACCT-<br>GAACCCCGACAACAGCGACGTGGACAAGCTGTTCATCCAGCTGGTG<br>CAGACCTACAACCAGCTGTTCGAGGAGAACCCCATCAACGCCAGCGGCGTGGACGC-<br>CAAGGCCATCCTGAGCGCCCGGCTGAGCAAGAGCCGGC<br>GGCTGGAGAACCT-<br>GATCGCCCAGCTGCCCGGCGAGAAGAAGAACGGCCTGTTCGGCAACCTGATCGCCCTGAGCCTGGGCCTGACCCCCAACTT<br>CAAGAGCAACTTCGACCTGGCCGAGGACGCCAAGCTGCAGCTGAGCAAGGACACC-<br>TACGACGACGACCTGGACAACCTGCTGGCCCAGATCGGC<br>GACCAGTACGCCGACCTGTTCCTGGCCGCCAAGAACCTGAGCGACGCCATCCTGCT-<br>GAGCGACATCCTGCGGGTGAACACCGAGATCACCAAGG<br>CCCCCCTGAGCGCCAGCATGATCAAGCGGTACGACGAGCAC-<br>CACCAGGACCTGACCCTGCTGAAGGCCCTGGTGCGGCAGCAGCTGCCCGAGAA<br>GTACAAGGAGATCTTCTTCGACCAGAGCAAGAACGGCTACGCCGGCTA-<br>CATCGACGGCGGCGCCAGCCAGGAGGAGTTCTACAAGTTCATCAAG<br>CCCATCCTGGAGAAGATGGACGGCACCGAGGAGCTGCTGGTGAAGCTGAACCGG-<br>GAGGACCTGCTGCGGAAGCAGCGGACCTTCGACAACGGCA<br>GCATCCCCCACCAGATCCACCTGGGCGAGCTGCACGCCATCCTGCGGCGGCAG-<br>GAGGACTTCTACCCCTTCCTGAAGGACAACCGGGAGAAGAT<br>CGAGAAGATCCTGACCTTCCGGATCCCCTAC-<br>TACGTGGGCCCCCTGGCCCGGGGCAACAGCCGGTTCGCCTGGATGACCCGGAAGAGCGAGGAG<br>ACCATCACCCCCTGGAACTTCGAGGAGGTGGTGGACAAGGGCGCCAGCGCCCAGAGCTT-<br>CATCGAGCGGATGACCAACTTCGACAAGAACCTGC<br>CCAACGAGAAGGTGCTGCCCAAGCACAGCCTGCTGTACGAGTACTTCACCGTGTA-<br>CAACGAGCTGACCAAGGTGAAGTACGTGACCGAGGGCAT<br>GCGGAAGCCCGCCTTCCTGAGCGGCGAGCAGAAGAAGGCCATCGTGGACCTGCTGTTCAA-<br>GACCAACCGGAAGGTGACCGTGAAGCAGCTGAAG<br>GAGGACTACTTCAAGAAGATCGAGTGCTTCGACAGCGTGGAGATCAGCGGCGTG-<br>GAGGACCGGTTCAACGCCAGCCTGGGCACCTACCACGACC<br>TGCTGAAGATCATCAAGGACAAGGACTTCCTGGACAACGAGGAGAACGAGGACATCCTG-<br>GAGGACATCGTGCTGACCCTGACCCTGTTCGAGGA<br>CCGGGAGATGATCGAGGAGCGGCTGAAGACCTACGCCCACCTGTTCGACGACAAGGTGAT-<br>GAAGCAGCTGAAGCGGCGGCGGTACACCGGCTGG<br>GGCCGGCTGAGCCGGAAGCTGATCAACGGCATCCGGGACAAGCAGAGCGGCAAGAC-<br>CATCCTGGACTTCCTGAAGAGCGACGGCTTCGCCAACC<br>GGAACTTCATGCAGCTGATCCACGACGACAGCCTGACCTTCAAGGAGGA-<br>CATCCAGAAGGCCCAGGTGAGCGGCCAGGGCGACAGCCTGCACGA<br>GCACATCGCCAACCTGGCCGGCAGCCCCGCCATCAAGAAGGGCATCCTGCAGACCGT-<br>GAAGGTGGTGGACGAGCTGGTGAAGGTGATGGGCCGG<br>CACAAGCCCGAGAACATCGTGATCGAGATGGCCCGGGAGAACCAGAC-<br>CACCCAGAAGGGCCAGAAGAACAGCCGGGAGCGGATGAAGCGGATCG<br>AGGAGGGCATCAAGGAGCTGGGCAGCCAGATCCTGAAGGAGCACCCCGTG-<br>GAGAACACCCAGCTGCAGAACGAGAAGCTGTACCTGTACTACCT<br>GCAGAACGGCCGGGACATGTACGTGGACCAGGAGCTGGACATCAACCGGCTGAGCGAC-<br>TACGACGTGGACCACATCGTGCCCCAGAGCTTCCTG | 155 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
| --- | --- | --- |
| fusion protein coding sequence) | AAGGACGACAGCATCGACAACAAGGTGCTGACCCG-<br>GAGCGACAAGAACCGGGGCAAGAGCGACAACGTGCCCAGCGAGGAGGTGGTGAAGAAGA<br>TGAAGAACTACTGGCGGCAGCTGCTGAACGCCAAGCTGATCACCCAGCG-<br>GAAGTTCGACAACCTGACCAAGGCCGAGCGGGGCGGCCTGAGCGA<br>GCTGGACAAGGCCGGCTTCATCAAGCGGCAGCTGGTGGAGACCCGGCAGATCAC-<br>CAAGCACGTGGCCCAGATCCTGGACAGCCGGATGAACACC<br>AAGTACGACGAGAACGACAAGCTGATCCGGGAGGTGAAGGTGATCACCCT-<br>GAAGAGCAAGCTGGTGAGCGACTTCCGGAAGGACTTCCAGTTCT<br>ACAAGGTGCGGGAGATCAACAACTACCACCACGCCCACGACGCCTACCT-<br>GAACGCCGTGGTGGGCACCGCCCTGATCAAGAAGTACCCCAAGCT<br>GGAGAGCGAGTTCGTGTACGGCGACTACAAGGTGTACGACGTGCGGAAGATGATCGC-<br>CAAGAGCGAGCAGGAGATCGGCAAGGCCACCGCCAAG<br>TACTTCTTCTACAGCAACATCATGAACTTCTTCAAGACCGAGATCACCCTGGC-<br>CAACGGCGAGATCCGGAAGCGGCCCCTGATCGAGACCAACG<br>GCGAGACCGGCGAGATCGTGTGGGACAAGGGCCGGGACTTCGCCACCGTGCG-<br>GAAGGTGCTGAGCATGCCCCAGGTGAACATCGTGAAGAAGAC<br>CGAGGTGCAGACCGGCGGCTTCAGCAAGGAGAGCATCCTGCCCAAGCG-<br>GAACAGCGACAAGCTGATCGCCCGGAAGAAGGACTGGGACCCCAAG<br>AAGTACGGCGGCTTCGACAGCCCCACCGTGGCCTACAGCGTGCTGGTGGTGGCCAAGGTG-<br>GAGAAGGGCAAGAGCAAGAAGCTGAAGAGCGTGA<br>AGGAGCTGCTGGGCATCACCATCATGGAGCGGAGCAGCTTCGAGAAGAACCC-<br>CATCGACTTCCTGGAGGCCAAGGGCTACAAGGAGGTGAAGAA<br>GGACCTGATCATCAAGCTGCCCAAGTACAGCCTGTTCGAGCTGGAGAACGGCCGGAAGCG-<br>GATGCTGGCCAGCGCCGGCGAGCTGCAGAAGGGC<br>AACGAGCTGGCCCTGCCCAGCAAGTACGTGAACTTCCTGTACCTGGCCAGCCAC-<br>TACGAGAAGCTGAAGGGCAGCCCCGAGGACAACGAGCAGA<br>AGCAGCTGTTCGTGGAGCAGCACAAGCACTACCTGGACGAGATCATCGAGCA-<br>GATCAGCGAGTTCAGCAAGCGGGTGATCCTGGCCGACGCCAA<br>CCTGGACAAGGTGCTGAGCGCCTACAACAAGCACCGGGACAAGCCCATCCGG-<br>GAGCAGGCCGAGAACATCATCCACCTGTTCACCCTGACCAAC<br>CTGGGCGCCCCCGCCGCCTTCAAGTACTTCGACACCACCATCGACCGGAAGCGGTA-<br>CACCAGCACCAAGGAGGTGCTGGACGCCACCCTGATCC<br>ACCAGAGCATCACCGGCCTGTACGAGACCCGGATCGACCT-<br>GAGCCAGCTGGGCGGCGACGGCAGCGGCAGCCCCAAGAAGAAGCGGAAGGTGGA<br>CGGCAGCCCCAAGAAGAAGCGGAAGGTGGACAGCGGC | |
| Cas9 ORF using low A/U codons of Table 4 (no NLS and no start or stop codons; suitable for inclusion | GACAAGAAGTACAGCATCGGCCTGGACATCGGCACCAACAGCGTGGGCTGGGCCGTGAT-<br>CACCGACGAGTACAAGGTGCCCAGCAAGAAGTTCA<br>AGGTGCTGGGCAACACCGACCGGCACAGCATCAAGAAGAACCT-<br>GATCGGCGCCCTGCTGTTCGACAGCGGCGAGACCGCCGAGGCCACCCGGCT<br>GAAGCGGACCGCCCGGCGGCGGTACACCCGGCGGAAGAACCGGATCTGCTACCTGCAG-<br>GAGATCTTCAGCAACGAGATGGCCAAGGTGGACGAC<br>AGCTTCTTCCACCGGCTGGAGGAGAGCTTCCTGGTGGAG-<br>GAGGACAAGAAGCACGAGCGGCACCCCATCTTCGGCAACATCGTGGACGAGGTGG<br>CCTACCACGAGAAGTACCCCACCATCTACCACCTGCG-<br>GAAGAAGCTGGTGGACAGCACCGACAAGGCCGACCTGCGGCTGATCTACCTGGCCCT<br>GGCCCACATGATCAAGTTCCGGGGCCACTTCCTGATCGAGGGCGACCT-<br>GAACCCCGACAACAGCGACGTGGACAAGCTGTTCATCCAGCTGGTG<br>CAGACCTACAACCAGCTGTTCGAGGAGAACCCCATCAACGCCAGCGGCGTGGACGC-<br>CAAGGCCATCCTGAGCGCCCGGCTGAGCAAGAGCCGGC<br>GGCTGGAGAACCT-<br>GATCGCCCAGCTGCCCGGCGAGAAGAAGAACGGCCTGTTCGGCAACCTGATCGCCCTGAGCCTGGGCCTGACCCCCAACTT<br>CAAGAGCAACTTCGACCTGGCCGAGGACGCCAAGCTGCAGCTGAGCAAGGACACC-<br>TACGACGACGACCTGGACAACCTGCTGGCCCAGATCGGC<br>GACCAGTACGCCGACCTGTTCCTGGCCGCCAAGAACCTGAGCGACGCCATCCTGCT-<br>GAGCGACATCCTGCGGGTGAACACCGAGATCACCAAGG<br>CCCCCCTGAGCGCCAGCATGATCAAGCGGTACGACGAGCAC-<br>CACCAGGACCTGACCCTGCTGAAGGCCCTGGTGCGGCAGCAGCTGCCCGAGAA<br>GTACAAGGAGATCTTCTTCGACCAGAGCAAGAACGGCTACGCCGGCTA-<br>CATCGACGGCGGCGCCAGCCAGGAGGAGTTCTACAAGTTCATCAAG<br>CCCATCCTGGAGAAGATGGACGGCACCGAGGAGCTGCTGGTGAAGCTGAACCGG-<br>GAGGACCTGCTGCGGAAGCAGCGGACCTTCGACAACGGCA<br>GCATCCCCCACCAGATCCACCTGGGCGAGCTGCACGCCATCCTGCGGCGGCAG-<br>GAGGACTTCTACCCCTTCCTGAAGGACAACCGGGAGAAGAT<br>CGAGAAGATCCTGACCTTCCGGATCCCCTAC-<br>TACGTGGGCCCCCTGGCCCGGGGCAACAGCCGGTTCGCCTGGATGACCCGGAAGAGCGAGGAG<br>ACCATCACCCCCTGGAACTTCGAGGAGGTGGTGGACAAGGGCGCCAGCGCCCAGAGCTT-<br>CATCGAGCGGATGACCAACTTCGACAAGAACCTGC<br>CCAACGAGAAGGTGCTGCCCAAGCACAGCCTGCTGTACGAGTACTTCACCGTGTA-<br>CAACGAGCTGACCAAGGTGAAGTACGTGACCGAGGGCAT<br>GCGGAAGCCCGCCTTCCTGAGCGGCGAGCAGAAGAAGGCCATCGTGGACCTGCTGTTCAA-<br>GACCAACCGGAAGGTGACCGTGAAGCAGCTGAAG<br>GAGGACTACTTCAAGAAGATCGAGTGCTTCGACAGCGTGGAGATCAGCGGCGTG-<br>GAGGACCGGTTCAACGCCAGCCTGGGCACCTACCACGACC<br>TGCTGAAGATCATCAAGGACAAGGACTTCCTGGACAACGAGGAGAACGAGGACATCCTG-<br>GAGGACATCGTGCTGACCCTGACCCTGTTCGAGGA | 156 |

-continued

Sequence Table
The following sequence table provides a listing of sequences disclosed herein. It is understood that if a DNA sequence (comprising Ts) is referenced with respect to an RNA, then Ts should be replaced with Us(which may be modified or unmodified depending on the context), and vice versa.

| Description | Sequence | SEQ ID No. |
|---|---|---|
| in fusion protein coding sequence) | CCGGGAGATGATCGAGGAGCGGCTGAAGACCTACGCCCACCTGTTCGACGACAAGGTGAT-GAAGCAGCTGAAGCGGCGGCGGTACACCGGCTGG GGCCGGCTGAGCCGGAAGCTGATCAACGGCATCCGGGACAAGCAGAGCGGCAAGAC-CATCCTGGACTTCCTGAAGAGCGACGGCTTCGCCAACC GGAACTTCATGCAGCTGATCCACGACGACAGCCTGACCTTCAAGGAGGA-CATCCAGAAGGCCCAGGTGAGCGGCCAGGGCGACAGCCTGCACGA GCACATCGCCAACCTGGCCGGCAGCCCCGCCATCAAGAAGGGCATCCTGCAGACCGT-GAAGGTGGTGGACGAGCTGGTGAAGGTGATGGGCCGG CACAAGCCCGAGAACATCGTGATCGAGATGGCCCGGGAGAACCAGAC-CACCCAGAAGGGCCAGAAGAACAGCCGGGAGCGGATGAAGCGGATCG AGGAGGGCATCAAGGAGCTGGGCAGCCAGATCCTGAAGGAGCACCCCGTG-GAGAACACCCAGCTGCAGAACGAGAAGCTGTACCTGTACTACCT GCAGAACGGCCGGGACATGTACGTGGACCAGGAGCTGGACATCAACCGGCTGAGCGAC-TACGACGTGGACCACATCGTGCCCCAGAGCTTCCTG AAGGACGACAGCATCGACAACAAGGTGCTGACCCG-GAGCGACAAGAACCGGGGCAAGAGCGACAACGTGCCCAGCGAGGAGGTGGTGAAGAAGA TGAAGAACTACTGGCGGCAGCTGCTGAACGCCAAGCTGATCACCCAGCG-GAAGTTCGACAACCTGACCAAGGCCGAGCGGGGCGGCCTGAGCGA GCTGGACAAGGCCGGCTTCATCAAGCGGCAGCTGGTGGAGACCCGGCAGATCAC-CAAGCACGTGGCCCAGATCCTGGACAGCCGGATGAACACC AAGTACGACGAGAACGACAAGCTGATCCGGGAGGTGAAGGTGATCACCCT-GAAGAGCAAGCTGGTGAGCGACTTCCGGAAGGACTTCCAGTTCT ACAAGGTGCGGGAGATCAACAACTACCACCACGCCCACGACGCCTACCT-GAACGCCGTGGTGGGCACCGCCCTGATCAAGAAGTACCCCAAGCT GGGAGAGCGAGTTCGTGTACGGCGACTACAAGGTGTACGACGTGCGGAAGATGATCGC-CAAGAGCGAGCAGGAGATCGGCAAGGCCACCGCCAAG TACTTCTTCTACAGCAACATCATGAACTTCTTCAAGACCGAGATCACCCTGGC-CAACGGCGAGATCCGGAAGCGGCCCCTGATCGAGACCAACG GCGAGACCGGCGAGATCGTGTGGGACAAGGGCCGGGACTTCGCCACCGTGCG-GAAGGTGCTGAGCATGCCCCAGGTGAACATCGTGAAGAAGAC CGAGGTGCAGACCGGCGGCTTCAGCAAGGAGAGCATCCTGCCCAAGCG-GAACAGCGACAAGCTGATCGCCCGGAAGAAGGACTGGGACCCCAAG AAGTACGGCGGCTTCGACAGCCCCACCGTGGCCTACAGCGTGCTGGTGGTGGCCAAGGTG-GAGAAGGGCAAGAGCAAGAAGCTGAAGAGCGTGA AGGAGCTGCTGGGCATCACCATCATGGAGCGGAGCAGCTTCGAGAAGAACCC-CATCGACTTCCTGGAGGCCAAGGGCTACAAGGAGGTGAAGAA GGACCTGATCATCAAGCTGCCCAAGTACAGCCTGTTCGAGCTGGAGAACGGCCGGAAGCG-GATGCTGGCCAGCGCCGGCGAGCTGCAGAAGGGC AACGAGCTGGCCCTGCCCAGCAAGTACGTGAACTTCCTGTACCTGGCCAGCCAC-TACGAGAAGCTGAAGGGCAGCCCCGAGGACAACGAGCAGA AGCAGCTGTTCGTGGAGCAGCACAAGCACTACCTGGACGAGATCATCGAGCA-GATCAGCGAGTTCAGCAAGCGGGTGATCCTGGCCGACGCCAA CCTGGACAAGGTGCTGAGCGCCTACAACAAGCACCGGGACAAGCCCATCCGG-GAGCAGGCCGAGAACATCATCCACCTGTTCACCCTGACCAAC CTGGGCGCCCCCGCCGCCTTCAAGTACTTCGACACCACCATCGACCGGAAGCGGTA-CACCAGCACCAAGGAGGTGCTGGACGCCACCCTGATCC ACCAGAGCATCACCGGCCTGTACGAGACCCGGATCGACCTGAGCCAGCTGGGCGGCGAC | |
| Cas9 nickase ORF using low A/U codons of Table 4 (no start or stop | GACAAGAAGTACAGCATCGGCCTGGCCATCGGCACCAACAGCGTGGGCTGGGCCGTGAT-CACCGACGAGTACAAGGTGCCCAGCAAGAAGTTCA AGGTGCTGGGCAACACCGACCGGCACAGCATCAAGAAGAACCT-GATCGGCGCCCTGCTGTTCGACAGCGGCGAGACCGCCGAGGCCACCCGGCT GAAGCGGACCGCCCGGCGGCGGTACACCCGGCGGAAGAACCGGATCTGCTACCTGCAGCAG-GAGATCTTCAGCAACGAGATGGCCAAGGTGGACGAC AGCTTCTTCCACCGGCTGGAGGAGAGCTTCCTGGTGGAG-GAGGACAAGAAGCACGAGCGGCACCCCATCTTCGGCAACATCGTGGACGAGGTGG CCTACCACGAGAAGTACCCCACCATCTACCACCTGCGC-GAAGAAGCTGGTGGACAGCACCGACAAGGCCGACCTGCGGCTGATCTACCTGGCCCT GGCCCACATGATCAAGTTCCGGGGCCACTTCCTGATCGAGGGCGACCT-GAACCCCGACAACAGCGACGTGGACAAGCTGTTCATCCAGCTGGTG CAGACCTACAACCAGCTGTTCGAGGAGAACCCCATCAACGCCAGCGGCGTGGACGC-CAAGGCCATCCTGAGCGCCCGGCTGAGCAAGAGCCGGC GGCTGGAGAACCT-GATCGCCCAGCTGCCCGGCGAGAAGAAGAACGGCCTGTTCGGCAACCTGATCGCCCTGAGCCTGGGCCTGACCCCCAACTT CAAGAGCAACTTCGACCTGGCCGAGGACGCCAAGCTGCAGCTGAGCAAGGACACC-TACGACGACGACCTGGACAACCTGCTGGCCCAGATCGGC GACCAGTACGCCGACCTGTTCCTGGCCGCCAAGAACCTGAGCGACGCCATCCTGCT-GAGCGACATCCTGCGGGTGAACACCGAGATCACCAAG CCCCCCTGAGCGCCAGCATGATCAAGCGGTACGACGAGCAC-CACCAGGACCTGACCCTGCTGAAGGCCCTGGTGCGGCAGCAGCTGCCCGAGAA GTACAAGGAGATCTTCTTCGACCAGAGCAAGAACGGCTACGCCGGCTA-CATCGACGGCGGCGCCAGCCAGGAGGAGTTCTACAAGTTCATCAAG CCCATCCTGGAGAAGATGGACGGCACCGAGGAGCTGCTGGTGAAGCTGAACCGG-GAGGACCTGCTGCGGAAGCAGCGGACCTTCGACAACGGCA GCATCCCCCACCAGATCCACCTGGGCGAGCTGCACGCCATCCTGCGCGGCCAG-GAGGACTTCTACCCCTTCCTGAAGGACAACCGGGAGAAGAT | 157 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| codons; suitable for inclusion in fusion protein coding sequence) | CGAGAAGATCCTGACCTTCCGGATCCCCTAC-<br>TACGTGGGCCCCCTGGCCCGGGGCAACAGCCGGTTCGCCTGGATGACCCGGAAGAGCGAGGAG<br>ACCATCACCCCCTGGAACTTCGAGGAGGTGGTGGACAAGGGCGCCAGCGCCCAGAGCTT-<br>CATCGAGCGGATGACCAACTTCGACAAGAACCTGC<br>CCAACGAGAAGGTGCTGCCCAAGCACAGCCTGCTGTACGAGTACTTCACCGTGTA-<br>CAACGAGCTGACCAAGGTGAAGTACGTGACCGAGGGCAT<br>GCGGAAGCCCGCCTTCCTGAGCGGCGAGCAGAAGAAGGCCATCGTGGACCTGCTGTTCAA-<br>GACCAACCGGAAGGTGACCGTGAAGCAGCTGAAG<br>GAGGACTACTTCAAGAAGATCGAGTGCTTCGACAGCGTGGAGATCAGCGGCGTG-<br>GAGGGACCGGTTCAACGCCAGCCTGGGCACCTACCACGACC<br>TGCTGAAGATCATCAAGGACAAGGACTTCCTGGACAACGAGGAGAACGAGGACATCCTG-<br>GAGGACATCGTGCTGACCCTGACCCTGTTCGAGGA<br>CCGGGAGATGATCGAGGAGCGGCTGAAGACCTACGCCCACCTGTTCGACGACAAGGTGAT-<br>GAAGCAGCTGAAGCGGCGGCGGTACACCGGCTGG<br>GGCCGGCTGAGCCGGAAGCTGATCAACGGCATCCGGGACAAGCAGAGCGGCAAGAC-<br>CATCCTGGACTTCCTGAAGAGCGACGGCTTCGCCAACC<br>GGAACTTCATGCAGCTGATCCACGACGACAGCCTGACCTTCAAGGAGGA-<br>CATCCAGAAGGCCCAGGTGAGCGGCCAGGGCGACAGCCTGCACGA<br>GCACATCGCCAACCTGGCCGGCAGCCCCGCCATCAAGAAGGGCATCCTGCAGACCGT-<br>GAAGGTGGTGGACGAGCTGGTGAAGGTGATGGGCCGG<br>CACAAGCCCGAGAACATCGTGATCGAGATGGCCCGGGAGAACCAGAC-<br>CACCCAGAAGGGCCAGAAGAACAGCCGGGAGCGGATGAAGCGGATCG<br>AGGAGGGCATCAAGGAGCTGGGCAGCCAGATCCTGAAGGAGCACCCCGTG-<br>GAGAACACCCAGCTGCAGAACGAGAAGCTGTACCTGTACTACCT<br>GCAGAACGGCCGGGACATGTACGTGGACCAGGAGCTGGACATCAACCGGCTGAGCGAC-<br>TACGACGTGGACCACATCGTGCCCCAGAGCTTCCTG<br>AAGGACGACAGCATCGACAACAAGGTGCTGACCCG-<br>GAGCGACAAGAACCGGGGCAAGAGCGACAACGTGCCCAGCGAGGAGGTGGTGAAGAAGA<br>TGAAGAACTACTGGCGGCAGCTGCTGAACGCCAAGCTGATCACCCAGCG-<br>GAAGTTCGACAACCTGACCAAGGCCGAGCGGGGCGGCCTGAGCGA<br>GCTGGACAAGGCCGGCTTCATCAAGCGGCAGCTGGTGGAGACCCGGCAGATCAC-<br>CAAGCACGTGGCCCAGATCCTGGACAGCCGGATGAACACC<br>AAGTACGACGAGAACGACAAGCTGATCCGGGAGGTGAAGGTGATCACCCT-<br>GAAGAGCAAGCTGGTGAGCGACTTCCGGAAGGACTTCCAGTTCT<br>ACAAGGTGCGGGAGATCAACAACTACCACCACGCCCACGACGCCTACCT-<br>GAACGCCGTGGTGGGCACCGCCCTGATCAAGAAGTACCCCAAGCT<br>GGAGAGCGAGTTCGTGTACGGCGACTACAAGGTGTACGACGTGCGGAAGATGATCGC-<br>CAAGAGCGAGCAGGAGATCGGCAAGGCCACCGCCAAG<br>TACTTCTTCTACAGCAACATCATGAACTTCTTCAAGACCGAGATCACCCTGGC-<br>CAACGGCGAGATCCGGAAGCGGCCCCTGATCGAGACCAACG<br>GCGAGACCGGCGAGATCGTGTGGGACAAGGGCCGGGACTTCGCCACCGTGCG-<br>GAAGGTGCTGAGCATGCCCCAGGTGAACATCGTGAAGAAGAC<br>CGAGGTGCAGACCGGCGGCTTCAGCAAGGAGAGCATCCTGCCCAAGCG-<br>GAACAGCGACAAGCTGATCGCCCGGAAGAAGGACTGGGACCCCAAG<br>AAGTACGGCGGCTTCGACAGCCCCACCGTGGCCTACAGCGTGCTGGTGGTGGCCAAGGTG-<br>GAGAAGGGCAAGAGCAAGAAGCTGAAGAGCGTGA<br>AGGAGCTGCTGGGCATCACCATCATGGAGCGGAGCAGCTTCGAGAAGAACCC-<br>CATCGACTTCCTGGAGGCCAAGGGCTACAAGGAGGTGAAGAA<br>GGACCTGATCATCAAGCTGCCCAAGTACAGCCTGTTCGAGCTGGAGAACGGCCGGAAGCG-<br>GATGCTGGCCAGCGCCGGCGAGCTGCAGAAGGGC<br>AACGAGCTGGCCCTGCCCAGCAAGTACGTGAACTTCCTGTACCTGGCCAGCCAC-<br>TACGAGAAGCTGAAGGGCAGCCCCGAGGACAACGAGCAGA<br>AGCAGCTGTTCGTGGAGCAGCACAAGCACTACCTGGACGAGATCATCGAGCA-<br>GATCAGCGAGTTCAGCAAGCGGGTGATCCTGGCCGACGCCAA<br>CCTGGACAAGGTGCTGAGCGCCTACAACAAGCACCGGGACAAGCCCATCCGG-<br>GAGCAGGCCGAGAACATCATCCACCTGTTCACCCCTGACCAAC<br>CTGGGCGCCCCCGCCGCCTTCAAGTACTTCGACACCACCATCGACCGGAAGCGGTA-<br>CACCAGCACCAAGGAGGTGCTGGACGCCACCCTGATCC<br>ACCAGAGCATCACCGGCCTGTACGAGACCCGGATCGACCT-<br>GAGCCAGCTGGGCGGCGACGGCGGCGGCAGCCCCAAGAAGAAGCGGAAGGTG | |
| Cas9 nickase ORF using low A/U | GACAAGAAGTACAGCATCGGCCTGGCCATCGGCACCAACAGCGTGGGCTGGGCCGTGAT-<br>CACCGACGAGTACAAGGTGCCCAGCAAGAAGTTCA<br>AGGTGCTGGGCAACACCGACCGGCACAGCATCAAGAAGAACCT-<br>GATCGGCGCCCTGCTGTTCGACAGCGGCGAGACCGCCGAGGCCACCCGGCT<br>GAAGCGGACCGCCCGGCGGCGGTACACCCGGCGGAAGAACCGGATCTGCTACCTGCAG-<br>GAGATCTTCAGCAACGAGATGGCCAAGGTGGACGAC<br>AGCTTCTTCCACCGGCTGGAGGAGAGCTTCCTGGTGGAG-<br>GAGGACAAGAAGCACGAGCGGCACCCCATCTTCGGCAACATCGTGGACGAGGTGG<br>CCTACCACGAGAAGTACCCCACCATCTACCACCTGCGC-<br>GAAGAAGCTGGTGGACAGCACCGACAAGGCCGACCTGCGGCTGATCTACCTGGCCCT<br>GGCCCACATGATCAAGTTCCGGGGCCACTTCCTGATCGAGGGCGACCT-<br>GAACCCCGACAACAGCGACGTGGACAAGCTGTTCATCCAGCTGGTG<br>CAGACCTACAACCAGCTGTTCGAGGAGAACCCCATCAACGCCAGCGGCGTGGACGC-<br>CAAGGCCATCCTGAGCGCCCGGCTGAGCAAGAGCCGGC | 158 |

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| codons of Table 4, with two C-terminal NLS sequences (no start or stop codons; suitable for inclusion in fusion protein coding sequence) | GGCTGGAGAACCT-GATCGCCCAGCTGCCCGGCGAGAAGAAGAACGGCCTGTTCGGCAACCTGATCGCCCTGAGCCTGGGCCTGACCCCCAACTT CAAGAGCAACTTCGACCTGGCCGAGGACGCCAAGCTGCAGCTGAGCAAGGACACC-TACGACGACGACCTGGACAACCTGCTGGCCCAGATCGGC GACCAGTACGCCGACCTGTTCCTGGCCGCCAAGAACCTGAGCGACGCCATCCTGCT-GAGCGACATCCTGCGGGTGAACACCGAGATCACCAAGG CCCCCCCTGAGCGCCAGCATGATCAAGCGGTACGACGAGCAC-CACCAGGACCTGACCCTGCTGAAGGCCCTGGTGCGGCAGCAGCTGCCCGAGAA GTACAAGGAGATCTTCTTCGACCAGAGCAAGAACGGCTACGCCGGCTA-CATCGACGGCGGCGCCAGCCAGGAGGAGTTCTACAAGTTCATCAAG CCCATCCTGGAAGATGGACGGCACCGAGGAGCTGCTGGTGAAGCTGAACCGG-GAGGACCTGCTGCGGAAGCAGCGGACCTTCGACAACGGCA GCATCCCCCACCAGATCCACCTGGGCGAGCTGCACGCCATCCTGCGGCGGCAG-GAGGACTTCTACCCCTTCCTGAAGGACAACCGGGAAGAT CGAGAAGATCCTGACCTTCCGGATCCCCTAC-TACGTGGGCCCCCTGGCCCGGGGCAACAGCCGGTTCGCCTGGATGACCCGGAAGAGCGAGGAG ACCATCACCCCCTGGAACTTCGAGGAGGTGGTGGACAAGGGCGCCAGCGCCCAGAGCTT-CATCGAGCGGATGACCAACTTCGACAAGAACCTGC CCAACGAGAAGGTGCTGCCCAAGCACAGCCTGCTGTACGAGTACTTCACCGTGTA-CAACGAGCTGACCAAGGTGAAGTACGTGACCGAGGGCAT GCGGAAGCCCGCCTTCCTGAGCGGCGAGCAGAAGAAGGCCATCGTGGACCTGCTGTTCAA-GACCAACCGGAAGGTGACCGTGAAGCAGCTGAAG GAGGACTACTTCAAGAAGATCGAGTGCTTCGACAGCGTGGAGATCAGCGGCGTG-GAGGACCGGTTCAACGCCAGCCTGGGCACCTACCACGACC TGCTGAAGATCATCAAGGACAAGGACTTCCTGGACAACGAGGAGAACGAGGACATCCTG-GAGGACATCGTGCTGACCCTGACCCTGTTCGAGGA CCGGGAGATGATCGAGGAGCGGCTGAAGACCTACGCCCACCTGTTCGACGACAAGGTGAT-GAAGCAGCTGAAGCGGCGGCGGTACACCGGCTGG GGCCGGCTGAGCCGGAAGCTGATCAACGGCATCCGGGACAAGCAGAGCGGCAAGAC-CATCCTGGACTTCCTGAAGAGCGACGGCTTCGCCAACC GGAACTTCATGCAGCTGATCCACGACGACAGCCTGACCTTCAAGGAGGA-CATCCAGAAGGCCCAGGTGAGCGGCCAGGGCGACAGCCTGCACGA GCACATCGCCAACCTGGCCGGCAGCCCCGCCATCAAGAAGGGCATCCTGCAGACCGT-GAAGGTGGTGGACGAGCTGGTGAAGGTGATGGGCCGG CACAAGCCCGAGAACATCGTGATCGAGATGGCCCGGGAGAACCAGAC-CACCCAGAAGGGCCAGAAGAACAGCCGGGAGCGGATGAAGCGGATCG AGGAGGGCATCAAGGAGCTGGGCAGCCAGATCCTGAAGGAGCACCCCGTG-GAGAACACCCAGCTGCAGAACGAGAAGCTGTACCTGTACTACCT GCAGAACGGCCGGGACATGTACGTGGACCAGGAGCTGGACATCAACCGGCTGAGCGAC-TACGACGTGGACCACATCGTGCCCCAGAGCTTCCTG AAGGACGACAGCATCGACAACAAGGTGCTGACCCG-GAGCGACAAGAACCGGGGCAAGAGCGACAACGTGCCCAGCGAGGAGGTGGTGAAGAAGA TGAAGAACTACTGGCGGCAGCTGCTGAACGCCAAGCTGATCACCCAGCG-GAAGTTCGACAACCTGACCAAGGCCGAGCGGGGCGGCCTGAGCGA GCTGGACAAGGCCGGCTTCATCAAGCGGCAGCTGGTGGAGACCCGGCAGATCAC-CAAGCACGTGGCCCAGATCCTGGACAGCCGGATGAACACC AAGTACGACGAGAACGACAAGCTGATCCGGGAGGTGAAGGTGATCACCCT-GAAGAGCAAGCTGGTGAGCGACTTCCGGAAGGACTTCCAGTTCT ACAAGGTGCGGGAGATCAACAACTACCACCACGCCCACGACGCCTACCT-GAACGCCGTGGTGGGCACCGCCCTGATCAAGAAGTACCCCAAGCT GGGAGAGCGAGTTCGTGTACGGCGACTACAAGGTGTACGACGTGCGGAAGATGATCGC-CAAGAGCGAGCAGGAGATCGGCAAGGCCACCGCCAAG TACTTCTTCTACAGCAACATCATGAACTTCTTCAAGACCGAGATCACCCTGGC-CAACGGCGAGATCCGGAAGCGGCCCCTGATCGAGACCAACG GCGAGACCGGCGAGATCGTGTGGGACAAGGGCCGGGACTTCGCCACCGTGCG-GAAGGTGCTGAGCATGCCCCAGGTGAACATCGTGAAGAAGAC CGAGGTGCAGACCGGCGGCTTCAGCAAGGAGAGCATCCTGCCCAAGCG-GAACAGCGACAAGCTGATCGCCCGGAAGAAGGACTGGGACCCCAAG AAGTACGGCGGCTTCGACAGCCCCACCGTGGCCTACAGCGTGCTGGTGGTGGCCAAGGTG-GAGAAGGGCAAGAGCAAGAAGCTGAAGAGCGTGA AGGAGCTGCTGGGCATCACCATCATGGAGCGGAGCAGCTTCGAGAAGAACCC-CATCGACTTCCTGGAGGCCAAGGGCTACAAGGAGGTGAAGAA GGACCTGATCATCAAGCTGCCCAAGTACAGCCTGTTCGAGCTGGAGAACGGCCGGAAGCG-GATGCTGGCCAGCGCCGGCGAGCTGCAGAAGGGC AACGAGCTGGCCCTGCCCAGCAAGTACGTGAACTTCCTGTACCTGGCCAGCCAC-TACGAGAAGCTGAAGGGCAGCCCCGAGGACAACGAGCAGA AGCAGCTGTTCGTGGAGCAGCACAAGCACTACCTGGACGAGATCATCGAGCA-GATCAGCGAGTTCAGCAAGCGGGTGATCCTGGCCGACGCCAA CCTGGACAAGGTGCTGAGCGCCTACAACAAGCACCGGGACAAGCCCATCCGG-GAGCAGGCCGAGAACATCATCCACCTGTTCACCCTGACCAAC CTGGGCGCCCCCGCCGCCTTCAAGTACTTCGACACCACCATCGACCGGAAGCGGTA-CACCAGCACCAAGGAGGTGCTGGACGCCACCCTGATCC ACCAGAGCATCACCGGCCTGTACGAGACCCGGATCGACCT-GAGCCAGCTGGGCGGCGACGGCAGCGGCAGCCCCAAGAAGAAGCGGAAGGTGGA CGGCAGCCCCAAGAAGAAGCGGAAGGTGGACAGCGGC | |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| Cas9 nickase ORF using low A/U codons of Table 4 (no NLS and no start or stop codons; suitable for inclusion in fusion protein coding sequence) | GACAAGAAGTACAGCATCGGCCTGGcCATCGGCACCAACAGCGTGGGCTGGGCCGTGAT-CACCGACGAGTACAAGGTGCCCAGCAAGAAGTTCA AGGTGCTGGGCAACACCGACCGGCACAGCATCAAGAAGAACCT-GATCGGCGCCCTGCTGTTCGACAGCGGCGAGACCGCCGAGGCCACCCGGCT GAAGCGGACCGCCCGGCGGCGGTACACCCGGCGGAAGAACCGGATCTGCTACCTGCAG-GAGATCTTCAGCAACGAGATGGCCAAGGTGGACGAC AGCTTCTTCCACCGGCTGGAGGAGAGCTTCCTGGTGGAG-GAGGACAAGAAGCACGAGCGGCACCCCATCTTCGGCAACATCGTGGACGAGGTGG CCTACCACGAGAAGTACCCCACCATCTACCACCTGCG-GAAGAAGCTGGTGGACAGCACCGACAAGGCCGACCTGCGGCTGATCTACCTGGCCCT GGCCCACATGATCAAGTTCCGGGGCCACTTCCTGATCGAGGGCGACCT-GAACCCCGACAACAGCGACGTGGACAAGCTGTTCATCCAGCTGGTG CAGACCTACAACCAGCTGTTCGAGGAGAACCCCATCAACGCCAGCGGCGTGGACGC-CAAGGCCATCCTGAGCGCCCGGCTGAGCAAGAGCCGGC GGCTGGAGAACCT-GATCGCCCAGCTGCCCGGCGAGAAGAAGAACGGCCTGTTCGGCAACCTGATCGCCCTGAGCCTGGGCCTGACCCCCAACTT CAAGAGCAACTTCGACCTGGCCGAGGACGCCAAGCTGCAGCTGAGCAAGGACACC-TACGACGACGACCTGGACAACCTGCTGGCCCAGATCGGC GACCAGTACGCCGACCTGTTCCTGGCCGCCAAGAACCTGAGCGACGCCATCCTGCT-GAGCGACATCCTGCGGGTGAACACCGAGATCACCAAGG CCCCCCTGAGCGCCAGCATGATCAAGCGGTACGACGAGCAC-CACCAGGACCTGACCCTGCTGAAGGCCCTGGTGCGGCAGCAGCTGCCCGAGAA GTACAAGGAGATCTTCTTCGACCAGAGCAAGAACGGCTACGCCGGCTA-CATCGACGGCGGCGCCAGCCAGGAGGAGTTCTACAAGTTCATCAAG CCCATCCTGGAGAAGATGGACGGCACCGAGGAGCTGCTGGTGAAGCTGAACCGG-GAGGACCTGCTGCGGAAGCAGCGGACCTTCGACAACGGCA GCATCCCCCACCAGATCCACCTGGGCGAGCTGCACGCCATCCTGCGGCGGCAG-GAGGACTTCTACCCCTTCCTGAAGGACAACCGGGAGAAGAT CGAGAAGATCCTGACCTTCCGGATCCCCTAC-TACGTGGGCCCCCTGGCCCGGGGCAACAGCCGGTTCGCCTGGATGACCCGGAAGAGCGAGGAG ACCATCACCCCCTGGAACTTCGAGGAGGTGGTGGACAAGGGCGCCAGCGCCCAGAGCTT-CATCGAGCGGATGACCAACTTCGACAAGAACCTGC CCAACGAGAAGGTGCTGCCCAAGCACAGCCTGCTGTACGAGTACTTCACCGTGTA-CAACGAGCTGACCAAGGTGAAGTACGTGACCGAGGGCAT GCGGAAGCCCGCCTTCCTGAGCGGCGAGCAGAAGAAGGCCATCGTGGACCTGCTGTTCAA-GACCAACCGGAAGGTGACCGTGAAGCAGCTGAAG GAGGACTACTTCAAGAAGATCGAGTGCTTCGACAGCGTGGAGATCAGCGGCGTG-GAGGACCGGTTCAACGCCAGCCTGGGCACCTACCACGACC TGCTGAAGATCATCAAGGACAAGGACTTCCTGGACAACGAGGAGAACGAGGACATCCTG-GAGGACATCGTGCTGACCCTGACCCTGTTCGAGGA CCGGGAGATGATCGAGGAGCGGCTGAAGACCTACGCCCACCTGTTCGACGACAAGGTGAT-GAAGCAGCTGAAGCGGCGGCGGTACACCGGCTGG GGCCGGCTGAGCCGGAAGCTGATCAACGGCATCCGGGACAAGCAGAGCGGCAAGAC-CATCCTGGACTTCCTGAAGAGCGACGGCTTCGCCAACC GGAACTTCATGCAGCTGATCCACGACGACAGCCTGACCTTCAAGGAGGA-CATCCAGAAGGCCCAGGTGAGCGGCCAGGGCGACAGCCTGCACGA GCACATCGCCAACCTGGCCGGCAGCCCCGCCATCAAGAAGGGCATCCTGCAGACCGT-GAAGGTGGTGGACGAGCTGGTGAAGGTGATGGGCCGG CACAAGCCCGAGAACATCGTGATCGAGATGGCCCGGGAGAACCAGAC-CACCCAGAAGGGCCAGAAGAACAGCCGGGAGCGGATGAAGCGGATCG AGGAGGGCATCAAGGAGCTGGGCAGCCAGATCCTGAAGGAGCACCCCGTG-GAGAACACCCAGCTGCAGAACGAGAAGCTGTACCTGTACTACCT GCAGAACGGCCGGGACATGTACGTGGACCAGGAGCTGGACATCAACCGGCTGAGCGAC-TACGACGTGGACCACATCGTGCCCCAGAGCTTCCTG AAGGACGACAGCATCGACAACAAGGTGCTGACCCG-GAGCGACAAGAACCGGGGCAAGAGCGACAACGTGCCCAGCGAGGAGGTGGTGAAGAAGA TGAAGAACTACTGGCGGCAGCTGCTGAACGCCAAGCTGATCACCCAGCG-GAAGTTCGACAACCTGACCAAGGCCGAGCGGGGCGGCCTGAGCGA GCTGGACAAGGCCGGCTTCATCAAGCGGCAGCTGGTGGAGACCCGGCAGATCAC-CAAGCACGTGGCCCAGATCCTGGACAGCCGGATGAACACC AAGTACGACGAGAACGACAAGCTGATCCGGGAGGTGAAGGTGATCACCCT-GAAGAGCAAGCTGGTGAGCGACTTCCGGAAGGACTTCCAGTTCT ACAAGGTGCGGGAGATCAACAACTACCACCACGCCCACGACGCCTACCT-GAACGCCGTGGTGGGCACCGCCCTGATCAAGAAGTACCCCAAGCT GGAGAGCGAGTTCGTGTACGGCGACTACAAGGTGTACGACGTGCGGAAGATGATCGC-CAAGAGCGAGCAGGAGATCGGCAAGGCCACCGCCAAG TACTTCTTCTACAGCAACATCATGAACTTCTTCAAGACCGAGATCACCCTGGC-CAACGGCGAGATCCGGAAGCGGCCCCTGATCGAGACCAACG GCGAGACCGGCGAGATCGTGTGGGACAAGGGCCGGGACTTCGCCACCGTGCG-GAAGGTGCTGAGCATGCCCCAGGTGAACATCGTGAAGAAGAC CGAGGTGCAGACCGGCGGCTTCAGCAAGGAGAGCATCCTGCCCAAGCG-GAACAGCGACAAGTGATCGCCCGGAAGAAGGACTGGGACCCCAAG AAGTACGGCGGCTTCGACAGCCCCACCGTGGCCTACAGCGTGCTGGTGGTGGCCAAGGTG-GAGAAGGGCAAGAGCAAGAAGCTGAAGAGCGTGA AGGAGCTGCTGGGCATCACCATCATGGAGCGGAGCAGCTTCGAGAAGAACCC-CATCGACTTCCTGGAGGCCAAGGGCTACAAGGAGGTGAAGAA | 159 |

| Description | Sequence | SEQ ID No. |
|---|---|---|
| | GGACCTGATCATCAAGCTGCCCAAGTACAGCCTGTTCGAGCTGGAGAACGGCCGGAAGCG-<br>GATGCTGGCCAGCGCCGGCGAGCTGCAGAAGGGC<br>AACGAGCTGGCCCTGCCCAGCAAGTACGTGAACTTCCTGTACCTGGCCAGCCAC-<br>TACGAGAAGCTGAAGGGCAGCCCCGAGGACAACGAGCAGA<br>AGCAGCTGTTCGTGGAGCAGCACAAGCACTACCTGGACGAGATCATCGAGCA-<br>GATCAGCGAGTTCAGCAAGCGGGTGATCCTGGCCGACGCCAA<br>CCTGGACAAGGTGCTGAGCGCCTACAACAAGCACCGGGACAAGCCCATCCGG-<br>GAGCAGGCCGAGAACATCATCCACCTGTTCACCCTGACCAAC<br>CTGGGCGCCCCCGCCGCCTTCAAGTACTTCGACACCACCATCGACCGGAAGCGGTA-<br>CACCAGCACCAAGGAGGTGCTGGACGCCACCCTGATCC<br>ACCAGAGCATCACCGGCCTGTACGAGACCCGGATCGACCTGAGCCAGCTGGGCGGCGAC | |
| dCas9 ORF using low A/U codons of Table 4 (no start or stop codons; suit- able for inclu- sion in fusion protein coding se- quence) | GACAAGAAGTACAGCATCGGCCTGGcCATCGGCACCAACAGCGTGGGCTGGGCCGTGAT-<br>CACCGACGAGTACAAGGTGCCCAGCAAGAAGTTCA<br>AGGTGCTGGGCAACACCGACCGGCACAGCATCAAGAAGAACCT-<br>GATCGGCGCCCTGCTGTTCGACAGCGGCGAGACCGCCGAGGCCACCCGGCT<br>GAAGCGGACCGCCCGGCGGCGGTACACCCGGCGGAAGAACCGGATCTGCTACCTGCAG-<br>GAGATCTTCAGCAACGAGATGGCCAAGGTGGACGAC<br>AGCTTCTTCCACCGGCTGGAGGAGAGCTTCCTGGTGGAG-<br>GAGGACAAGAAGCACGAGCGGCACCCCATCTTCGGCAACATCGTGGACGAGGTGG<br>CCTACCACGAGAAGTACCCCACCATCTACCACCTGCG-<br>GAAGAAGCTGGTGGACAGCACCGACAAGGCCGACCTGCGGCTGATCTACCTGGCCCT<br>GGCCCACATGATCAAGTTCCGGGGCCACTTCCTGATCGAGGGCGACCT-<br>GAACCCCGACAACAGCGACGTGGACAAGCTGTTCATCCAGCTGGTG<br>CAGACCTACAACCAGCTGTTCGAGGAGAACCCCATCAACGCCAGCGGCGTGGACGC-<br>CAAGGCCATCCTGAGCGCCCGGCTGAGCAAGAGCCGGC<br>GGCTGGAGAACCT-<br>GATCGCCCAGCTGCCCGGCGAGAAGAAGAACGGCCTGTTCGGCAACCTGATCGCCCTGAGCCTGGGCCTGACCCCCAACTT<br>CAAGAGCAACTTCGACCTGGCCGAGGACGCCAAGCTGCAGCTGAGCAAGGACACC-<br>TACGACGACGACCTGGACAACCTGCTGGCCCAGATCGGC<br>GACCAGTACGCCGACCTGTTCCTGGCCGCCAAGAACCTGAGCGACGCCATCCTGCT-<br>GAGCGACATCCTGCGGGTGAACACCGAGATCACCAAGG<br>CCCCCCTGAGCGCCAGCATGATCAAGCGGTACGACGAGCAC-<br>CACCAGGACCTGACCCTGCTGAAGGCCCTGGTGCGGCAGCAGCTGCCCGAGAA<br>GTACAAGGAGATCTTCTTCGACCAGAGCAAGAACGGCTACGCCGGCTA-<br>CATCGACGGCGGCGCCAGCCAGGAGGAGTTCTACAAGTTCATCAAG<br>CCCATCCTGGAGAAGATGGACGGCACCGAGGAGCTGCTGGTGAAGCTGAACCGG-<br>GAGGACCTGCTGCGGAAGCAGCGGACCTTCGACAACGGCA<br>GCATCCCCCACCAGATCCACCTGGGCGAGCTGCACGCCATCCTGCGCGGCGGCAG-<br>GAGGACTTCTACCCCTTCCTGAAGGACAACCGGGAGAAGAT<br>CGAGAAGATCCTGACCTTCCGGATCCCCTAC-<br>TACGTGGGCCCCCTGGCCCGGGGCAACAGCCGGTTCGCCTGGATGACCCGGAAGAGCGAGGAG<br>ACCATCACCCCCTGGAACTTCGAGGAGGTGGTGGACAAGGGCGCCAGCGCCCAGAGCTT-<br>CATCGAGCGGATGACCAACTTCGACAAGAACCTGC<br>CCAACGAGAAGGTGCTGCCCAAGCACAGCCTGCTGTACGAGTACTTCACCGTGTA-<br>CAACGAGCTGACCAAGGTGAAGTACGTGACCGAGGGCAT<br>GCGGAAGCCCGCCTTCCTGAGCGGCGAGCAGAAGAAGGCCATCGTGGACCTGCTGTTCAA-<br>GACCAACCGGAAGGTGACCGTGAAGCAGCTGAAG<br>GAGGACTACTTCAAGAAGATCGAGTGCTTCGACAGCGTGGAGATCAGCGGCGTG-<br>GAGGACCGGTTCAACGCCAGCCTGGGCACCTACCACGACC<br>TGCTGAAGATCATCAAGGACAAGGACTTCCTGGACAACGAGGAGAACGAGGACATCCTG-<br>GAGGACATCGTGCTGACCCTGACCCTGTTCGAGGA<br>CCGGGAGATGATCGAGGAGCGGCTGAAGACCTACGCCCACCTGTTCGACGACAAGGTGAT-<br>GAAGCAGCTGAAGCGGCGGCGGTACACCGGCTGG<br>GGCCGGCTGAGCCGGAAGCTGATCAACGGCATCCGGGACAAGCAGAGCGGCAAGAC-<br>CATCCTGGACTTCCTGAAGAGCGACGGCTTCGCCAACC<br>GGAACTTCATGCAGCTGATCCACGACGACAGCCTGACCTTCAAGGAGGA-<br>CATCCAGAAGGCCCAGGTGAGCGGCCAGGGCGACAGCCTGCACGA<br>GCACATCGCCAACCTGGCCGGCAGCCCCGCCATCAAGAAGGGCATCCTGCAGACCGT-<br>GAAGGTGGTGGACGAGCTGGTGAAGGTGATGGGCCGG<br>CACAAGCCCGAGAACATCGTGATCGAGATGGCCCGGGAGAACCAGAC-<br>CACCCAGAAGGGCCAGAAGAACAGCCGGGAGCGGATGAAGCGGATCG<br>AGGAGGGCATCAAGGAGCTGGGCAGCCAGATCCTGAAGGAGCACCCCGTG-<br>GAGAACACCCAGCTGCAGAACGAGAAGCTGTACCTGTACTACCT<br>GCAGAACGGCCGGGACATGTACGTGGACCAGGAGCTGGACATCAACCGGCTGAGCGAC-<br>TACGACGTGGACgcCATCGTGCCCCAGAGCTTCCTG<br>AAGGACGACAGCATCGACAACAAGGTGCTGACCCG-<br>GAGCGACAAGAACCGGGGCAAGAGCGACAACGTGCCCAGCGAGGAGGTGGTGAAGAAGA<br>TGAAGAACTACTGGCGGCAGCTGCTGAACGCCAAGCTGATCACCCAGCG-<br>GAAGTTCGACAACCTGACCAAGGCCGAGCGGGGCGGCCTGAGCGA<br>GCTGGACAAGGCCGGCTTCATCAAGCGGCAGCTGGTGGAGACCCGGCAGATCAC-<br>CAAGCACGTGGCCCAGATCCTGGACAGCCGGATGAACACC<br>AAGTACGACGAGAACGACAAGCTGATCCGGGAGGTGAAGGTGATCACCCT-<br>GAAGAGCAAGCTGGTGAGCGACTTCCGGAAGGACTTCCAGTTCT<br>ACAAGGTGCGGGAGATCAACAACTACCACCACGCCCACGACGCCTACCT-<br>GAACGCCGTGGTGGGCACCGCCCTGATCAAGAAGTACCCCAAGCT | 160 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | GGAGAGCGAGTTCGTGTACGGCGACTACAAGGTGTACGACGTGCGGAAGATGATCGC-<br>CAAGAGCGAGCAGGAGATCGGCAAGGCCACCGCCAAG<br>TACTTCTTCTACAGCAACATCATGAACTTCTTCAAGACCGAGATCACCCTGGC-<br>CAACGGCGAGATCCGGAAGCGGCCCCTGATCGAGACCAACG<br>GCGAGACCGGCGAGATCGTGTGGGACAAGGGCCGGGACTTCGCCACCGTGCG-<br>GAAGGTGCTGAGCATGCCCCAGGTGAACATCGTGAAGAAGAC<br>CGAGGTGCAGACCGGCGGCTTCAGCAAGGAGAGCATCCTGCCCAAGCG-<br>GAACAGCGACAAGCTGATCGCCCGGAAGAAGGACTGGGACCCCAAG<br>AAGTACGGCGGCTTCGACAGCCCCACCGTGGCCTACAGCGTGCTGGTGGTGGCCAAGGTG-<br>GAGAAGGGCAAGAGCAAGAAGCTGAAGAGCGTGA<br>AGGAGCTGCTGGGCATCACCATCATGGAGCGGAGCAGCTTCGAGAAGAACCC-<br>CATCGACTTCCTGGAGGCCAAGGGCTACAAGGAGGTGAAGAA<br>GGACCTGATCATCAAGCTGCCCAAGTACAGCCTGTTCGAGCTGGAGAACGGCCGGAAGCG-<br>GATGCTGGCCAGCGCCGGCGAGCTGCAGAAGGGC<br>AACGAGCTGGCCCTGCCCAGCAAGTACGTGAACTTCCTGTACCTGGCCAGCCAC-<br>TACGAGAAGCTGAAGGGCAGCCCCGAGGACAACGAGCAGA<br>AGCAGCTGTTCGTGGAGCAGCACAAGCACTACCTGGACGAGATCATCGAGCA-<br>GATCAGCGAGTTCAGCAAGCGGGTGATCCTGGCCGACGCCAA<br>CCTGGACAAGGTGCTGAGCGCCTACAACAAGCACCGGGACAAGCCCATCCGG-<br>GAGCAGGCCGAGAACATCATCCACCTGTTCACCCTGACCAAC<br>CTGGGCGCCCCCGCCGCCTTCAAGTACTTCGACACCACCATCGACCGGAAGCGGTA-<br>CACCAGCACCAAGGAGGTGCTGGACGCCACCCTGATCC<br>ACCAGAGCATCACCGGCCTGTACGAGACCCGGATCGACCT-<br>GAGCCAGCTGGGCGGCGACGGCGGCGGCAGCCCCAAGAAGAAGCGGAAGGTG | |
| dCas9 ORF using low A/U codons of Table 4, with two C-terminal NLS sequences (no start or stop codons; suitable for inclu- | GACAAGAAGTACAGCATCGGCCTGGCCATCGGCACCAACAGCGTGGGCTGGGCCGTGAT-<br>CACCGACGAGTACAAGGTGCCCAGCAAGAAGTTCA<br>AGGTGCTGGGCAACACCGACCGGCACAGCATCAAGAAGAACCT-<br>GATCGGCGCCCTGCTGTTCGACAGCGGCGAGACCGCCGAGGCCACCCGGCT<br>GAAGCGGACCGCCCGGCGGCGGTACACCCGGCGGAAGAACCGGATCTGCTACCTGCAG-<br>GAGATCTTCAGCAACGAGATGGCCAAGGTGGACGAC<br>AGCTTCTTCCACCGGCTGGAGGAGAGCTTCCTGGTGGAG-<br>GAGGACAAGAAGCACGAGCGGCACCCCATCTTCGGCAACATCGTGGACGAGGTGG<br>CCTACCACGAGAAGTACCCCACCATCTACCACCTGCGC-<br>GAAGAAGCTGGTGGACAGCACCGACAAGGCCGACCTGCGCCTGATCTACCTGGCCCT<br>GGCCCACATGATCAAGTTCCGGGGCCACTTCCTGATCGAGGGCGACCT-<br>GAACCCCGACAACAGCGACGTGGACAAGCTGTTCATCCAGCTGGTG<br>CAGACCTACAACCAGCTGTTCGAGGAGAACCCCATCAACGCCAGCGGCGTGGACGC-<br>CAAGGCCATCCTGAGCGCCCGGCTGAGCAAGAGCCGGC<br>GGCTGGAGAACCT-<br>GATCGCCCAGCTGCCCGGCGAGAAGAAGAACGGCCTGTTCGGCAACCTGATCGCCCTGAGCCTGGGCCTGACCCCCAACTT<br>CAAGAGCAACTTCGACCTGGCCGAGGACGCCAAGCTGCAGCTGAGCAAGGACACC-<br>TACGACGACGACCTGGACAACCTGCTGGCCCAGATCGGC<br>GACCAGTACGCCGACCTGTTCCTGGCCGCCAAGAACCTGAGCGACGCCATCCTGCT-<br>GAGCGACATCCTGCGGGTGAACACCGAGATCACCAAGG<br>CCCCCCTGAGCGCCAGCATGATCAAGCGGTACGACGAGCAC-<br>CACCAGGACCTGACCCTGCTGAAGGCCCTGGTGCGGCAGCAGCTGCCCGAGAA<br>GTACAAGGAGATCTTCTTCGACCAGAGCAAGAACGGCTACGCCGGCTA-<br>CATCGACGGCGGCGCCAGCCAGGAGGAGTTCTACAAGTTCATCAAG<br>CCCATCCTGGAGAAGATGGACGGCACCGAGGAGCTGCTGGTGAAGCTGAACCGG-<br>GAGGACCTGCTGCGGAAGCAGCGGACCTTCGACAACGGCA<br>GCATCCCCCACCAGATCCACCTGGGCGAGCTGCACGCCATCCTGCGCGGCGGCAG-<br>GAGGACTTCTACCCCTTCCTGAAGGACAACCGGGAGAAGAT<br>CGAGAAGATCCTGACCTTCCGGATCCCCTAC-<br>TACGTGGGCCCCCTGGCCCGGGGCAACAGCCGGTTCGCCTGGATGACCCGGAAGAGCGAGGAG<br>ACCATCACCCCCTGGAACTTCGAGGAGGTGGTGGACAAGGGCGCCAGCGCCCAGAGCTT-<br>CATCGAGCGGATGACCAACTTCGACAAGAACCTGC<br>CCAACGAGAAGGTGCTGCCCAAGCACAGCCTGCTGTACGAGTACTTCACCGTGTA-<br>CAACGAGCTGACCAAGGTGAAGTACGTGACCGAGGGCAT<br>GCGGAAGCCCGCCTTCCTGAGCGGCGAGCAGAAGAAGGCCATCGTGGACCTGCTGTTCAA-<br>GACCAACCGGAAGGTGACCGTGAAGCAGCTGAAG<br>GAGGACTACTTCAAGAAGATCGAGTGCTTCGACAGCGTGGAGATCAGCGGCGTG-<br>GAGGACCGGTTCAACGCCAGCCTGGGCACCTACCACGACC<br>TGCTGAAGATCATCAAGGACAAGGACTTCCTGGACAACGAGGAGAACGAGGACATCCTG-<br>GAGGACATCGTGCTGACCCTGACCCTGTTCGAGGA<br>CCGGGAGATGATCGAGGAGCGGCTGAAGACCTACGCCCACCTGTTCGACGACAAGGTGAT-<br>GAAGCAGCTGAAGCGGCGGCGGTACACCGGCTGG<br>GGCCGGCTGAGCCGGAAGCTGATCAACGGCATCCGGGACAAGCAGAGCGGCAAGAC-<br>CATCCTGGACTTCCTGAAGAGCGACGCCTTCGCCAACC<br>GGAACTTCATGCAGCTGATCCACGACGACAGCCTGACCTTCAAGGAGGA-<br>CATCCAGAAGGCCCAGGTGAGCGGCCAGGGCGACAGCCTGCACGA<br>GCACATCGCCAACCTGGCCGGCAGCCCCGCCATCAAGAAGGGCATCCTGCAGACCGT-<br>GAAGGTGGTGGACGAGCTGGTGAAGGTGATGGGCCGG<br>CACAAGCCCGAGAACATCGTGATCGAGATGGCCCGGGAGAACCAGAC-<br>CACCCAGAAGGGCCAGAAGAACAGCCGGGAGCGGATGAAGCGGATCG | 161 |

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| sion in fusion protein coding sequence) | AGGAGGGCATCAAGGAGCTGGGCAGCCAGATCCTGAAGGAGCACCCCGTG-GAGAACACCCAGCTGCAGAACGAGAAGCTGTACCTGTACTACCT GCAGAACGGCCGGGACATGTACGTGGACCAGGAGCTGGACATCAACCGGCTGAGCGAC-TACGACGTGGACGCCATCGTGCCCCAGAGCTTCCTG AAGGACGACAGCATCGACAACAAGGTGCTGACCCG-GAGCGACAAGAACCGGGGCAAGAGCGACAACGTGCCCAGCGAGGAGGTGGTGAAGAAGA TGAAGAACTACTGGCGGCAGCTGCTGAACGCCAAGCTGATCACCCAGCG-GAAGTTCGACAACCTGACCAAGGCCGAGCGGGGCGGCCTGAGCGA GCTGGACAAGGCCGGCTTCATCAAGCGGCAGCTGGTGGAGACCCGGCAGATCAC-CAAGCACGTGGCCCAGATCCTGGACAGCCGGATGAACACC AAGTACGACGAGAACGACAAGCTGATCCGGGAGGTGAAGGTGATCACCCT-GAAGAGCAAGCTGGTGAGCGACTTCCGGAAGGACTTCCAGTTCT ACAAGGTGCGGGAGATCAACAACTACCACCACGCCCACGACGCCTACCT-GAACGCCGTGGTGGGCACCGCCCTGATCAAGAAGTACCCCAAGCT GGGAGAGCGAGTTCGTGTACGGCGACTACAAGGTGTACGACGTGCGGAAGATGATCGC-CAAGAGCGAGCAGGAGATCGGCAAGGCCACCGCCAAG TACTTCTTCTACAGCAACATCATGAACTTCTTCAAGACCGAGATCACCCTGGC-CAACGGCGAGATCCGGAAGCGGCCCCTGATCGAGACCAACG GCGAGACCGGCGAGATCGTGTGGGACAAGGGCCGGGACTTCGCCACCGTGCG-GAAGGTGCTGAGCATGCCCCAGGTGAACATCGTGAAGAAGAC CGAGGTGCAGACCGGCGGCTTCAGCAAGGAGAGCATCCTGCCCAAGCG-GAACAGCGACAAGCTGATCGCCCGGAAGAAGGACTGGGACCCCAAG AAGTACGGCGGCTTCGACAGCCCCACCGTGGCCTACAGCGTGCTGGTGGTGGCCAAGGTG-GAGAAGGGCAAGAGCAAGAAGCTGAAGAGCGTGA AGGAGCTGCTGGGCATCACCATCATGGAGCGGAGCAGCTTCGAGAAGAACCC-CATCGACTTCCTGGAGGCCAAGGGCTACAAGGAGGTGAAGAA GGACCTGATCATCAAGCTGCCCAAGTACAGCCTGTTCGAGCTGGAGAACGGCCGGAAGCG-GATGCTGGCCAGCGCCGGCGAGCTGCAGAAGGGC AACGAGCTGGCCCTGCCCAGCAAGTACGTGAACTTCCTGTACCTGGCCAGCCAC-TACGAGAAGCTGAAGGGCAGCCCCGAGGACAACGAGCAGA AGCAGCTGTTCGTGGAGCAGCACAAGCACTACCTGGACGAGATCATCGAGCA-GATCAGCGAGTTCAGCAAGCGGGTGATCCTGGCCGACGCCAA CCTGGACAAGGTGCTGAGCGCCTACAACAAGCACGGGACAAGCCCATCCGG-GAGCAGGCCGAGAACATCATCCACCTGTTCACCCTGACCAAC CTGGGCGCCCCCGCCGCCTTCAAGTACTTCGACACCACCATCGACCGGAAGCGGTA-CACCAGCACCAAGGAGGTGCTGGACGCCACCCTGATCC ACCAGAGCATCACCGGCCTGTACGAGACCCGGATCGACCT-GAGCCAGCTGGGCGGCGACGGCAGCGGCAGCCCCAAGAAGAAGCGGAAGGTGGA CGGCAGCCCCAAGAAGAAGCGGAAGGTGGACAGCGGC | |
| dCas9 ORF using low A/U codons of Table 4 (no NLS and no start or stop codons; suit- able for | GACAAGAAGTACAGCATCGGCCTGGCcATCGGCACCAACAGCGTGGGCTGGGCCGTGAT-CACCGACGAGTACAAGGTGCCCAGCAAGAAGTTCA AGGTGCTGGGCAACACCGACCGGCACAGCATCAAGAAGAACCT-GATCGGCGCCCTGCTGTTCGACAGCGGCGAGACCGCCGAGGCCACCCGGCT GAAGCGGACCGCCCGGCGGCGGTACACCCGGCGGAAGAACCGGATCTGCTACCTGCAG-GAGATCTTCAGCAACGAGATGGCCAAGGTGGACGAC AGCTTCTTCCACCGGCTGGAGGAGAGCTTCCTGGTGGAG-GAGGACAAGAAGCACGAGCGGCACCCCATCTTCGGCAACATCGTGGACGAGGTGG CCTACCACGAGAAGTACCCCACCATCTACCACCTGCGC-GAAGAAGCTGGTGGACAGCACCGACAAGGCCGACCTGCGGCTGATCTACCTGGCCCT GGCCCACATGATCAAGTTCCGGGGCCACTTCCTGATCGAGGGCGACCT-GAACCCCGACAACAGCGACGTGGACAAGCTGTTCATCCAGCTGGTG CAGACCTACAACCAGCTGTTCGAGGAGAACCCCATCAACGCCAGCGGCGTGGACGC-CAAGGCCATCCTGAGCGCCCGGCTGAGCAAGAGCCGGC GGCTGGAGAACCT-GATCGCCCAGCTGCCCGGCGAGAAGAAGAACGGCCTGTTCGGCAACCTGATCGCCCTGAGCCTGGGCCTGACCCCCAACTT CAAGAGCAACTTCGACCTGGCCGAGGACGCCAAGCTGCAGCTGAGCAAGGACACC-TACGACGACGACCTGGACAACCTGCTGGCCCAGATCGGC GACCAGTACGCCGACCTGTTCCTGGCCGCCAAGAACCTGAGCGACGCCATCCTGCT-GAGCGACATCCTGCGGGTGAACACCGAGATCACCAAGG CCCCCCTGAGCGCCAGCATGATCAAGCGGTACGACGAGCAC-CACCAGGACCTGACCCTGCTGAAGGCCCTGGTGCGGCAGCAGCTGCCCGAGAA GTACAAGGAGATCTTCTTCGACCAGAGCAAGAACGGCTACGCCGGCTA-CATCGACGGCGGCGCCAGCCAGGAGGAGTTCTACAAGTTCATCAAG CCCATCCTGGAGAAGATGGACGGCACCGAGGAGCTGCTGGTGAAGCTGAACCGG-GAGGACCTGCTGCGGAAGCAGCGGACCTTCGACAACGGCA GCATCCCCCACCAGATCCACCTGGGCGAGCTGCACGCCATCCTGCGGCGGCAG-GAGGACTTCTACCCCTTCCTGAAGGACAACCGGGAGAAGAT CGAGAAGATCCTGACCTTCCGGATCCCCTAC-TACGTGGGCCCCCTGGCCCGGGGCAACAGCCGGTTCGCCTGGATGACCCGGAAGAGCGAGGAG ACCATCACCCCCTGGAACTTCGAGGAGGTGGTGGACAAGGGCGCCAGCGCCCAGAGCTT-CATCGAGCGGATGACCAACTTCGACAAGAACCTGC CCAACGAGAAGGTGCTGCCCAAGCACAGCCTGCTGTACGAGTACTTCACCGTGTA-CAACGAGCTGACCAAGGTGAAGTACGTGACCGAGGGCAT GCGGAAGCCCGCCTTCCTGAGCGGCGAGCAGAAGAAGGCCATCGTGGACCTGCTGTTCAA-GACCAACCGGAAGGTGACCGTGAAGCAGCTGAAG | 162 |

| Description | Sequence | SEQ ID No. |
|---|---|---|
| inclusion in fusion protein coding sequence) | GAGGACTACTTCAAGAAGATCGAGTGCTTCGACAGCGTGGAGATCAGCGGCGTG-GAGGACCGGTTCAACGCCAGCCTGGGCACCTACCACGACC<br>TGCTGAAGATCATCAAGGACAAGGACTTCCTGGACAACGAGGAGAACGAGGACATCCTG-GAGGACATCGTGCTGACCCTGACCCTGTTCGAGGA<br>CCGGGAGATGATCGAGGAGCGGCTGAAGACCTACGCCCACCTGTTCGACGACAAGGTGAT-GAAGCAGCTGAAGCGGCGGCGGTACACCGGCTGG<br>GGCCGGCTGAGCCGGAAGCTGATCAACGGCATCCGGGACAAGCAGAGCGGCAAGAC-CATCCTGGACTTCCTGAAGAGCGACGGCTTCGCCAACC<br>GGAACTTCATGCAGCTGATCCACGACGACAGCCTGACCTTCAAGGAGGA-CATCCAGAAGGCCCAGGTGAGCGGCCAGGGCGACAGCCTGCACGA<br>GCACATCGCCAACCTGGCCGGCAGCCCCGCCATCAAGAAGGGCATCCTGCAGACCGT-GAAGGTGGTGGACGAGCTGGTGAAGGTGATGGGCCGG<br>CACAAGCCCGAGAACATCGTGATCGAGATGGCCCGGGAGAACCAGAC-CACCCAGAAGGGCCAGAAGAACAGCCGGGAGCGGATGAAGCGGATCG<br>AGGAGGGCATCAAGGAGCTGGGCAGCCAGATCCTGAAGGAGCACCCCGTG-GAGAACACCCAGCTGCAGAACGAGAAGCTGTACCTGTACTACCT<br>GCAGAACGGCCGGGACATGTACGTGGACCAGGAGCTGGACATCAACCGGCTGAGCGAC-TACGACGTGGACgcCATCGTGCCCCAGAGCTTCCTG<br>AAGGACGACAGCATCGACAACAAGGTGCTGACCCG-GAGCGACAAGAACCGGGGCAAGAGCGACAACGTGCCCAGCGAGGAGGTGGTGAAGAAGA<br>TGAAGAACTACTGGCGGCAGCTGCTGAACGCCAAGCTGATCACCCAGCG-GAAGTTCGACAACCTGACCAAGGCCGAGCGGGGCGGCCTGAGCGA<br>GCTGGACAAGGCCGGCTTCATCAAGCGGCAGCTGGTGGAGACCCGGCAGATCAC-CAAGCACGTGGCCCAGATCCTGGACAGCCGGATGAACACC<br>AAGTACGACGAGAACGACAAGCTGATCCGGGAGGTGAAGGTGATCACCCT-GAAGAGCAAGCTGGTGAGCGACTTCCGGAAGGACTTCCAGTTCT<br>ACAAGGTGCGGGAGATCAACAACTACCACCACGCCCACGACGCCTACCT-GAACGCCGTGGTGGGCACCGCCCTGATCAAGAAGTACCCCAAGCT<br>GGAGAGCGAGTTCGTGTACGGCGACTACAAGGTGTACGACGTGCGGAAGATGATCGC-CAAGAGCGAGCAGGAGATCGGCAAGGCCACCGCCAAG<br>TACTTCTTCTACAGCAACATCATGAACTTCTTCAAGACCGAGATCACCCTGGC-CAACGGCGAGATCCGGAAGCGGCCCCTGATCGAGACCAACG<br>GCGAGACCGGCGAGATCGTGTGGGACAAGGGCCGGGACTTCGCCACCGTGCG-GAAGGTGCTGAGCATGCCCCAGGTGAACATCGTGAAGAAGAC<br>CGAGGTGCAGACCGGCGGCTTCAGCAAGGAGAGCATCCTGCCCAAGCG-GAACAGCGACAAGCTGATCGCCCGGAAGAAGGACTGGGACCCCAAG<br>AAGTACGGCGGCTTCGACAGCCCCACCGTGGCCTACAGCGTGCTGGTGGTGGCCAAGGTG-GAGAAGGGCAAGAGCAAGAAGCTGAAGAGCGTGA<br>AGGAGCTGCTGGGCATCACCATCATGGAGCGGAGCAGCTTCGAGAAGAACCC-CATCGACTTCCTGGAGGCCAAGGGCTACAAGGAGGTGAAGAA<br>GGACCTGATCATCAAGCTGCCCAAGTACAGCCTGTTCGAGCTGGAGAACGGCCGGAAGCG-GATGCTGGCCAGCGCCGGCGAGCTGCAGAAGGGC<br>AACGAGCTGGCCCTGCCCAGCAAGTACGTGAACTTCCTGTACCTGGCCAGCCAC-TACGAGAAGCTGAAGGGCAGCCCCGAGGACAACGAGCAGA<br>AGCAGCTGTTCGTGGAGCAGCACAAGCACTACCTGGACGAGATCATCGAGCA-GATCAGCGAGTTCAGCAAGCGGGTGATCCTGGCCGACGCCAA<br>CCTGGACAAGGTGCTGAGCGCCTACAACAAGCACCGGGACAAGCCCATCCGG-GAGCAGGCCGAGAACATCATCCACCTGTTCACCCTGACCAAC<br>CTGGGCGCCCCCGCCGCCTTCAAGTACTTCGACACCACCATCGACCGGAAGCGGTA-CACCAGCACCAAGGAGGTGCTGGACGCCACCCTGATCC<br>ACCAGAGCATCACCGGCCTGTACGAGACCCGGATCGACCTGAGCCAGCTGGGCGGCGAC | |
| Nme Cas9 ORF using low A codons of Table 4 (no start or | GCCGCCTTCAAGCCCAACTCCATCAACTACATCCTGGGCCTGGACATCGG-CATCGCCTCCGTGGGCTGGGCCATGGTGGAGATCGACGAGGAGG<br>AGAACCCCATCCGGCTGATCGACCTGGGCGTGCGGGTGTTCGAGCGGGCCGAGGTGCC-CAAGACCGGCGACTCCCTGGCCATGGCCCGGCGGCT<br>GGCCCGGTCCGTGCGGCGGCTGACCCGGCGGCGGCC-CACCGGCTGCTGCGGACCCGGCGGCTGCTGAAGCGGGAGGGCGTGCTGCAGGCCGCC<br>AACTTCGACGAGAACGGCCTGATCAAGTCCCTGCC-CAACACCCCCTGGCAGCTGCGGGCCGCCGCCCTGGACCGGAAGCTGACCCCCCTGGAGT<br>GGTCCGCCGTGCTGCTGCACCTGATCAAGCACCGGGGCTACCTGTCCCAGCG-GAAGAACGAGGGCGAGACCGCCGACAAGGAGCTGGGCGCCCT<br>GCTGAAGGGCGTGGCCGGCAACGCCCACGCCCTGCA-GACCGGCGACTTCCGGACCCCCGCCGAGCTGGCCCTGAACAAGTTCGAGAAGGAGTCC<br>GGCCACATCCGGAACCAGCGGTCCGACTACTCCCACACCTTCTCCCG-GAAGGACCTGCAGGCCGAGCTGATCCTGCTGTTCGAGAAGCAGAAGG<br>AGTTCGGCAACCCCCACGTGTCCGGCGGCCTGAAGGAGGGCATCGAGACCCTGCT-GATGACCCAGCGGCCCGCCCTGTCCGGCGACGCCGTGCA<br>GAAGATGCTGGGCCACTGCACCTTCGAGCCCGCCGAGCCCAAGGCCGCCAAGAACACCTA-CACCGCCGAGCGGTTCATCTGGCTGACCAAGCTG<br>AACAACCTGCGGATCCTGGAGCAGGGCTCCGAGCGGCCCCTGACCGACACCGAGCGGGC-CACCCTGATGGACGAGCCTACCGGAAGTCCAAGC<br>TGACCTACGCCCAGGCCCGGAAGCTGCTGGGCCTGGAGGACACCGCCTTCTT-CAAGGGGCCTGCGGTACGGCAAGGACAACGCCGAGGCCTCCAC<br>CCTGATGGAGATGAAGGCCTACCACGCCATCTCCCGGGCCCTGGAGAAGGAGGGCCT-GAAGGACAAGAAGTCCCCCCTGAACCTGTCCCCCGAG | 163 |

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| stop codons; suitable for inclusion in fusion protein coding sequence) | CTGCAGGACGAGATCGGCACCGCCTTCTCCCTGTTCAAGACCGACGAGGACAT-CACCGGCCGGCTGAAGGACCGGATCCAGCCCGAGATCCTGG AGGCCCTGCTGAAGCACATCTCCTTCGACAAGTTCGTGCAGATCTCCCT-GAAGGCCCTGCGGCGGATCGTGCCCCTGATGGAGCAGGGCAAGCG GTACGACGAGGCCTGCGCCGAGATCTACGGCGACCACTACGGCAAGAAGAACACCGAG-GAGAAGATCTACCTGCCCCCCATCCCCGCCGACGAG ATCCGGAACCCCGTGGTGCTGCGGGCCCTGTCCCAGGCCCGGAAGGTGAT-CAACGGCGTGGTGCGGCGGTACGGCTCCCCCGCCCGGATCCACA TCGAGACCGCCCGGGAGGTGGGCAAGTCCTTCAAGGACCG-GAAGGAGATCGAGAAGCGGCAGGAGGAGAACCGGAAGGACCGGGAGAAGGCCGC CGCCAAGTTCCGGGAGTACTTCCCCAACTTCGTGGGCGAGCCCAAGTCCAAGGACATCCT-GAAGCTGCGGCTGTACGAGCAGCAGCACGGCAAG TGCCTGTACTCCGGCAAGGAGATCAACCTGGGCCGGCTGAACGAGAAGGGCTACGTG-GAGATCGACCACGCCCTGCCCTTCTCCCGGACCTGGG ACGACTCCTT-CAACAACAAGGTGCTGGTGCTGGGCTCCGAGAACCAGAACAAGGGCAACCAGACCCCCTACGAGTACTTCAACGGCAAGGACAA CTCCCGGGAGTGGCAGGAGTTCAAGGCCCGGGTGGAGACCTCCCGGTTCCCCCGGTC-CAAGAAGCAGCGGATCCTGCTGCAGAAGTTCGACGAG GACGGCTTCAAGGAGCGGAACCTGAACGACACCCGGTACGT-GAACCGGTTCCTGTGCCAGTTCGTGGCCGACCGGATGCGGCTGACCGGCAAGG GCAAGAAGCGGGTGTTCGCCTCCAACGGCCAGATCAC-CAACCTGCTGCGGGGCTTCTGGGGCCTGCGGAAGGTGCGGGCCGAGAACGACCGGCA CCACGCCCTGGACGCCGTGGTGGTGGCCTGCTCCACCGTGGCCATGCAGCAGAAGAT-CACCCGGTTCGTCGGTACAAGGAGATGAACGCCTTC GACGGCAAGACCATCGACAAGGAGACCGGCGAGGTGCTGCACCAGAAGACC-CACTTCCCCCAGCCCTGGGAGTTCTTCGCCCAGGAGGTGATGA TCCGGGTGTTCGGCAAGCCCGACGGCAAGCCCGAGTTCGAGGAGGCCGACACCCTG-GAGAAGCTGCGGGACCCTGCTGGCCGAGAAGCTGTCCTC CCGGCCCGAGGCCGTGCACGAGTACGTGACCCCCCTGTTCGTGTCCCGGGCCCCCAACCG-GAAGATGTCCGGCCAGGGCCACATGGAGACCGTG AAGTCCGCCAAGCGGCTGGACGAGGGCGTGTCCGTGCTGCGGGTGCCCCTGACCCAGCT-GAAGCTGAAGGACCTGGAGAAGATGGTGAACCGGG AGCGGGAGCCCAAGCTGTACGAGGCCCTGAAGGCCCGGCTGGAGGCC-CACAAGGACGACCCCGCCAAGGCCTTCGCCGAGCCCTTCTACAAGTA CGACAAGGCCGGCAACCGGACCCAGCAGGTGAAGGCCGTGCGGGTGGAGCAGGTGCAGAA-GACCGGCGTGTGGGTGCGGAACCACAACGGCATC GCCGACAACGCCACCATGGTGCGGGTGGACGTGTTCGAGAAGGGCGACAAGTAC-TACCTGGTGCCCATCTACTCCTGGCAGGTGGCCAAGGGCA TCCTGCCCGACCGGGCCGTGGTGCAGGGCAAGGACGAGGAGGACTGGCAGCT-GATCGACGACTCCTTCAACTTCAAGTTCTCCCTGCACCCCAA CGACCTGGTGGAGGTGATCACCAAGAAGGCCCGGATGTTCGGCTACTTCGCCTCCTGC-CACCGGGGCACCGGCAACATCAACATCCGGATCCAC GACCTGGACCACAAGATCGGCAAGAACGGCATCCTGGAGGGCATCGGCGTGAA-GACCGCCCTGTCCTTCCAGAAGTACCAGATCGACGAGCTGG GCAAGGAGATCCGGCCCTGCCGGCT-GAAGAAGCGGCCCCCCGTGCGGTCCGGCAAGCGGACCGCCGACGGCTCCGAGTTCGAGTCCCCCAAGAA GAAGCGGAAGGTGGAG | |
| Nme Cas9 ORF using low A/U codons of Table 4 (no start or stop | GCCGCCTTCAAGCCCAACAGCATCAACTACATCCTGGGCCTGGACATCGG-CATCGCCAGCGTGGGCTGGGCCATGGTGGAGATCGACGAGGAGG AGAACCCCATCCGGCTGATCGACCTGGGCGTGCGGGTGTTCGAGCGGGCCGAGGTGCC-CAAGACCGGCGACAGCCTGGCCATGGCCCGGCGGCT GGCCCGGAGCGTGCGGCGGCTGACCCGGCGGCGGGCC-CACCGGCTGCTGCGGACCCGGCGGCTGCTGAAGCGGGAGGGCGTGCTGCAGGCCGCC AACTTCGACGAGAACGGCCTGATCAAGAGCCTGCC-CAACACCCCTGGCAGCTGCGGGCCGCCGCCCTGGACCGGAAGCTGACCCCCCTGGAGT GGAGCGCCGTGCTGCTGCACCTGATCAAGCACCGGGGCTACCTGAGCCAGCG-GAAGAACGAGGGCGAGACCGCCGACAAGGAGCTGGGCGCCCT GCTGAAGGGCGTGGCCGGCAACGCCCACGCCCTGCA-GACCGGCGACTTCCGGACCCCCGCCGAGCTGGCCCTGAACAAGTTCGAGAAGGAGAGC GGCCACATCCGGAACCAGCGGAGCGACTACAGCCACACCTTCAGCCG-GAAGGACCTGCAGGCCGAGCTGATCCTGCTGTTCGAGAAGCAGAAGG AGTTCGGCAACCCCACGTGAGCGGCGGCCTGAAGGAGGGCATCGAGACCCTGCT-GATGACCCAGCGGCCCGCCCTGAGCGGCGACGCCGTGCA GAAGATGCTGGGCCACTGCACCTTCGAGCCCGCCGAGCCCAAGGCCGCCAAGAACACCTA-CACCGCCGAGCGGTTCATCTGGCTGACCAAGCTG AACAACCTGCGGATCCTGGAGCAGGGCAGCGAGCGGCCCCTGACCGACACCGAGCGGGC-CACCCTGATGGACGAGCCCTACCGGAAGAGCAAGC TGACCTACGCCCAGGCCCGGAAGCTGCTGGGCCTGGAGGACACCGCCTTCTT-CAAGGGCCTGCGGTACGGCAAGGACAACGCCGAGGCCAGCAC CCTGATGGAGATGAAGGCCTACCACGCCATCAGCCGGGCCCTGGAGAAGGAGGGCCT-GAAGGACAAGAAGAGCCCCCTGAACCTGAGCCCCGAG CTGCAGGACGAGATCGGCACCGCCTTCAGCCTGTTCAAGACCGACGAGGACAT-CACCGGCCGGCTGAAGGACCGGATCCAGCCCGAGATCCTGG AGGCCCTGCTGAAGCACATCAGCTTCGACAAGTTCGTGCAGATCAGCCT-GAAGGCCCTGCGGCGGATCGTGCCCCTGATGGAGCAGGGCAAGCG | 164 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| codons; suitable for inclusion in fusion protein coding sequence) | GTACGACGAGGCCTGCGCCGAGATCTACGGCGACCACTACGGCAAGAAGAACACCGAG-GAGAAGATCTACCTGCCCCCCATCCCCGCCGACGAG ATCCGGAACCCCGTGGTGCTGCGGGCCCTGAGCCAGGCCCGGAAGGTGAT-CAACGGCGTGGTGCGGCGGTACGGCAGCCCCGCCCGGATCCACA TCGAGACCGCCCGGGAGGTGGGCAAGAGCTTCAAGGACCG-GAAGGAGATCGAGAAGCGGCAGGAGGAGAACCGGAAGGACCGGGAGAAGGCCGC CGCCAAGTTCCGGGAGTACTTCCCCAACTTCGTGGGCGAGCCCAAGAGCAAGGACATCCT-GAAGCTGCGGCTGTACGAGCAGCAGCACGGCAAG TGCCTGTACAGCGGCAAGGAGATCAACCTGGGCCGGCTGAACAGAGAAGGGCTACGTG-GAGATCGACCACGCCCTGCCCTTCAGCCGGACCTGGG ACGACAGCTT-CAACAACAAGGTGCTGGTGCTGGGCAGCGAGAACCAGAACAAGGGCAACCAGACCCCCTACGAGTACTTCAACGGCAAGGACAA CAGCCGGGAGTGGCAGGAGTTCAAGGCCCGGGTGGAGACCAGCCGGTTCCCCCG-GAGCAAGAAGCAGCGGATCCTGCTGCAGAAGTTCGACGAG GACGGCTTCAAGGAGCGGAACCTGAACGACACCCGGTACGT-GAACCGGTTCCTGTGCCAGTTCGTGGCCGACCGGATGCGGCTGACCGGCAAGG GCAAGAAGCGGGTGTTCGCCAGCAACGGCCAGATCAC-CAACCTGCTGCGGGGCTTCTGGGGCCTGCGGAAGGTGCGGGCCGAGAACGACCGGCA CCACGCCCTGGACGCCGTGGTGGTGGCCTGCAGCACCGTGGCCATGCAGCAGAAGAT-CACCCGGTTCGTGCGGTACAAGGAGATGAACGCCTTC GACGGCAAGACCATCGACAAGGAGACCGGCGAGGTGCTGCACCAGAAGACC-CACTTCCCCCAGCCCTGGGAGTTCTTCGCCCAGGAGGTGATGA TCCGGGTGTTCGGCAAGCCCGACGGCAAGCCCGAGTTCGAGGAGGCCGACACCCTG-GAGAAGCTGCGGACCCTGCTGGCCGAGAAGCTGAGCAG CCGGCCCGAGGCCGTGCACGAGTACGTGACCCCCCTGTTCGTGAGCCGGGCCCCCAACCG-GAAGATGAGCGGCCAGGGCCACATGGAGACCGTG AAGAGCGCCAAGCGGCTGGACGAGGGCGTGAGCGTGCTGCGGGTGCCCCTGACCCAGCT-GAAGCTGAAGGACCTGGAGAAGATGGTGAACCGGG AGCGGGAGCCCAAGCTGTACGAGGCCCTGAAGGCCCGGCTGGAGGCC-CACAAGGACGACCCCGCCAAGGCCTTCGCCGAGCCCTTCTACAAGTA CGACAAGGCCGGCAACCGGGACCCAGCAGGTGAAGGCCGTGCGGGTGGAGCAGGTGCAGAA-GACCGGCGTGTGGGTGCGGAACCACAACGGCATC GCCGACAACGCCACCATGGTGCGGGTGGACGTGTTCGAGAAGGGCGACAAGTAC-TACCTGGTGCCCATCTACAGCTGGCAGGTGGCCAAGGGCA TCCTGCCCGACCGGGCCGTGGTGCAGGGCAAGGACGAGGAGGACTGGCAGCT-GATCGACGACAGCTTCAACTTCAAGTTCAGCCTGCACCCCAA CGACCTGGTGGAGGTGATCACCAAGAAGGCCCGGATGTTCGGCTACTTCGCCAGCTGC-CACCGGGGCACCGGCAACATCAACATCCGGATCCAC GACCTGGACCACAAGATCGGCAAGAACCGGCATCCTGGAGGGCATCGGCGTGAA-GACCGCCCTGAGCTTCCAGAAGTACCAGATCGACGAGCTGG GCAAGGAGATCCGGCCCTGCCGGCTGAAGAAGCGGCCCCCCGTGCG-GAGCGGCAAGCGGACCGCCGACGGCAGCGAGTTCGAGAGCCCCAAGAA GAAGCGGAAGGTGGAG | |
| Open reading frame for Cas9 with NLS1 (no start or stop codons; suitable for | GACAAGAAGTACAGCATCGGACTGGACATCGGAACAAACAGCGTCGGATGGGCAGTCAT-CACAGACGAATACAAGGTCCCGAGCAAGAAGTTCA AGGTCCTGGGAAACACAGACAGACACAGCATCAAGAAGAACCTGATCG-GAGCACTGCTGTTCGACAGCGGAGAAACAGCAGAAGCAACAAGACT GAAGAGAACAGCAAGAAGAAGATACAAGGAAGAAAGAACAGAATCTGCTACCTGCAG-GAAATCTTCAGCAACGAAATGGCAAAGGTCGACGAC AGCTTCTTCCACAGACTGGAAGAAAGCTTCCTGGTCGAAGAAGACAAGAAGCACGAAA-GACACCCGATCTTCGGAAACATCGTCGACGAAGTCG CATACCACGAAAAGTACCCGACAATCTACCACCTGAGAAAGAAGCTGGTCGACAGCACA-GACAAGGCAGACCTGAGACTGATCTACCTGGCACT GGCACACATGATCAAGTTCAGAGGACACTTCCTGATCGAAGGAGACCT-GAACCCGGACAACAGCGACGTCGACAAGCTGTTCATCCAGCTGGTC CAGACATACAACCAGCTGTTCGAAGAAAACCCGATCAACGCAAGCG-GAGTCGACGCAAAGGCAATCCTGAGCGCAAGACTGAGCAAGAGCAGAA GACTGGAAAACCTGATCGCACAGCTGCCGGGAGAAAAGAAGAACGGACTGTTCG-GAAACCTGATCGCACTGAGCCTGGGACTGACACCGAACTT CAAGAGCAACTTCGACCTGGCAGAAGACGCAAAGCTGCAGCTGAGCAAGGACACAT-ACGACGACGACCTGGACAACCTGCTGGCACAGATCGGA GACCAGTACGCAGACCTGTTCCTGGCAGCAAAGAACCTGAGCGACGCAATCCTGCT-GAGCGACATCCTGAGAGTCAACACAGAAATCACAAAGG CACCGCTGAGCGCAAGCATGATCAAGAGATACGACGAACAC-CACCAGGACCTGACACTGCTGAAGGCACTGGTCAGACAGCAGCTGCCGGAAAA GTACAAGGAAATCTTCTTCGACCAGAGCAAGAACGGATACGCAGGATACATCGACGGAG-GAGCAAGCCAGGAAGAATTCTACAAGTTCATCAAG CCGATCCTGGAAAAGATGGACGGAACAGAAGAACTGCTGGTCAAGCTGAACAGAGAA-GACCTGCTGAGAAAGCAGAGAACATTCGACAACGGA GCATCCCGCACCAGATCCACCTGGGAGAACTGCACGCAATCCTGAGAAGACAGGAA-GACTTCTACCCGTTCCTGAAGGACAACAGAGAAAAGAT CGAAAAGATCCTGACATTCAGAATCCCGTACTACGTCGGACCGCTGGCAAGAG-GAAACAGCAGATTCGCATGGATGACAAGAAGAGCGAAGAA ACAATCACACCGTGGAACTTCGAAGAAGTCGTCGACAAGGGAGCAAGCGCACAGAGCTT-CATCGAAAGAATGACAAACTTCGACAAGAACCTGC | 165 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| inclusion in fusion protein coding sequence) | CGAACGAAAAGGTCCTGCCGAAGCACAGCCTGCTGTACGAATACTTCACAGTCTA-CAACGAACTGACAAAGGTCAAGTACGTCACAGAAGGAAT<br>GAGAAAGCCGGCATTCCTGAGCGGAGAACAGAAGAAGGCAATCGTCGACCTGCTGTTCAA-GACAAACAGAAAGGTCACAGTCAAGCAGCTGAAG<br>GAAGACTACTTCAAGAAGATCGAATGCTTCGACAGCGTCGAAATCAGCGGAGTCGAA-GACAGATTCAACGCAAGCCTGGGAACATACCACGACC<br>TGCTGAAGATCATCAAGGACAAGGACTTCCTGGACAACGAAGAAAACGAAGACATCCTG-GAAGACATCGTCCTGACACTGACACTGTTCGAAGA<br>CAGAGAAATGATCGAAGAAAGACTGAAGACATACGCACACCTGTTCGACGACAAGGTCAT-GAAGCAGCTGAAGAGAAGAAGATACACAGGATGG<br>GGAAGACTGAGCAGAAAGCTGATCAACGGAATCAGAGACAAGCAGAGCGGAAA-GACAATCCTGGACTTCCTGAAGAGCGACGGATTCGCAAACA<br>GAAACTTCATGCAGCTGATCCACGACGACAGCCTGACATTCAAGGAAGA-CATCCAGAAGGCACAGGTCAGCGGACAGGGAGACAGCCTGCACGA<br>ACACATCGCAAACCTGGCAGGAAGCCCGGCAATCAAGAAGGGAATCCTGCAGACAGT-CAAGGTCGTCGACGAACTGGTCAAGGTCATGGGAAGA<br>CACAAGCCGGAAAACATCGTCATCGAAATGGCAAGAGAGAAAACCA-GACAACACAGAAGGGACAGAAGAACAGCAGAGAAAGAATGAAGAGAATCG<br>AAGAAGGAATCAAGGAACTGGGAAGCCAGATCCT-GAAGGAACACCCGGTCGAAAACACACAGCTGCAGAACGAAAAGCTGTACCTGTACTACCT<br>GCAGAACGAAGAGACATGTACGTCGACCAGGAACTGGACATCAACAGACTGAGCGAC-TACGACGTCGACCACATCGTCCCGCAGAGCTTCCTG<br>AAGGACGACAGCATCGACAACAAGGTCCTGACAAGAAGCGACAAGAACAGAG-GAAGAGCGACAACGTCCCGAGCGAAGAAGTCGTCAAGAAGA<br>TGAAGAACTACTGGAGACAGCTGCTGAACGCAAAGCTGAT-CACACAGAGAAAGTTCGACAACCTGACAAAGGCAGAGAGAGGAGGACTGAGCGA<br>ACTGGACAAGGCAGGATTCATCAAGAGACAGCTGGTCGAAACAAGACAGAT-CACAAAGCACGTCGCACAGATCCTGGACAGCAGAATGAACACA<br>AAGTACGACGAAAACGACAAGCTGATCAGAGAAGTCAAGGTCATCACACT-GAAGAGCAAGCTGGTCAGCGACTTCAGAAAGGACTTCCAGTTCT<br>ACAAGGTCAGAGAAATCAACAACTACCACCACGCACACGACGCATACCT-GAACGCAGTCGTCGGAACAGCACTGATCAAGAAGTACCCGAAGCT<br>GGAAAGCGAATTCGTCTACGGAGACTACAAGGTCTACGACGTCAGAAAGAT-GATCGCAAAGAGCGAACAGGAAATCGGAAAGGCAACAGCAAAG<br>TACTTCTTCTACAGCAACATCATGAACTTCTTCAAGACAGAAATCACACTGGCAAACG-GAGAAATCAGAAAGAGACCGCTGATCGAAACAAACG<br>GAGAAACAGGAGAAATCGTCTGGGACAAGGGAAGA-GACTTCGCAACAGTCAGAAAGGTCCTGAGCATGCCGCAGGTCAACATCGTCAAGAAGAC<br>AGAAGTCCAGACAGGAGGAT-TCAGCAAGGAAAGCATCCTGCCGAAGAGAAACAGCGACAAGCTGATCGCAAGAAAGAAGGACTGGGACCCGAAG<br>AAGTACGGAGGATTCGACAGCCCGACAGTCGCATA-CAGCGTCCTGGTCGTCGCAAAGGTCGAAAAGGGAAAGAGCAAGAAGCTGAAGAGCGTCA<br>AGGAACTGCTGGGAATCACAATCATGGAAAGAAGCAGCTTCGAAAAGAACCC-GATCGACTTCCTGGAAGCAAAGGGATACAAGGAAGTCAAGAA<br>GGACCTGATCATCAAGCTGCCGAAGTACAGCCTGTTCGAACTGGAAAACG-GAAGAAAGAGAATGCTGGCAAGCGCAGGAGAACTGCAGAAGGGA<br>AACGAACTGGCACTGCCGAGCAAGTACGTCAACTTCCTGTACCTGGCAAGCCAC-TACGAAAAGCTGAAGGGAAGCCCGGAAGACAACGAACAGA<br>AGCAGCTGTTCGTCGAACAGCACAAGCACTACCTGGACGAAATCATCGAACA-GATCAGCGAATTCAGCAAGAGAGTCATCCTGGCAGACGCAAA<br>CCTGGACAAGGTCCTGAGCGCATACAACAAGCACAGAGACAAGCC-GATCAGAGAACAGGCAGAAAACATCATCCACCTGTTCACACTGACAAAC<br>CTGGGAGCACCGGCAGCATTCAAGTACTTCGACAACAATCGACAGAAAGAGATA-CACAAGCACAAAGGAAGTCCTGGACGCAACACTGATCC<br>ACCAGAGCATCACAGGACTGTACGAAACAAGAATCGACCTGAGCCAGCTGGGAGGAGACG-GAGGAGGAAGCCTGGCAGCAAAGAGAAGCAGAAC<br>AACA | |
| Open reading frame for Cas9 with NLS2 (no | GACAAGAAGTACAGCATCGGACTGGACATCGGAACAAACAGCGTCGGATGGGCAGTCAT-CACAGACGAATACAAGGTCCCGAGCAAGAAGTTCA<br>AGGTCCTGGGAAACACAGACAGACACAGCATCAAGAAGAACCTGATCG-GAGCACTGCTGTTCGACAGCGGAGAAACAGCAGAAGCAACAAGACT<br>GAAGAGAACAGCAAGAAGAAGATACAAGGAAAAGAACAGAATCTGCTACCTGCAG-GAAATCTTCAGCAACGAAATGGCAAAGGTCGACGAC<br>AGCTTCTTCCACAGACTGGAAGAAAGCTTCCTGGTCGAAGAAGACAAGAAGCACGAAA-GACACCCGATCTTCGGAAACATCGTCGACGAAGTCG<br>CATACCACGAAAAGTACCCGACAATCTACCACCTGAGAAAGAAGCTGGTCGACAGCACA-GACAAGGCAGACCTGAGACTGATCTACCTGGCACT<br>GGCACACATGATCAAGTTCAGAGGACACTTCCTGATCGAAGGAGACCT-GAACCCGGACAACAGCGACGTCGACAAGCTGTTCATCCAGCTGGTC<br>CAGACATACAACCAGCTGTTCGAAGAAAACCCGATCAACGCAAGCG-GAGTCGACGCAAAGGCAATCCTGAGCGCAAGACTGAGCAAGAGCAGAA<br>GACTGGAAAACCTGATCGCACAGCTGCCGGGAGAAAAGAAGAACGGACTGTTCG-GAAACCTGATCGCACTGAGCCTGGGACTGACACCGAACTT<br>CAAGAGCAACTTCGACCTGGCAGAAGACGCAAAGCTGCAGCTGAGCAAGGACACAT-ACGACGACGACCTGGACAACCTGCTGGCACAGATCGGA | 166 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| start or stop codons; suit- able for inclu- sion in fusion protein coding se- quence) | GACCAGTACGCAGACCTGTTCCTGGCAGCAAAGAACCTGAGCGACGCAATCCTGCT-<br>GAGCGACATCCTGAGAGTCAACACAGAAATCACAAAGG<br>CACCGCTGAGCGCAAGCATGATCAAGAGATACGACGAACAC-<br>CACCAGGACCTGACACTGCTGAAGGCACTGGTCAGACAGCAGCTGCCGGAAAA<br>GTACAAGGAAATCTTCTTCGACCAGAGCAAGAACGGATACGCAGGATACATCGACGGAG-<br>GAGCAAGCCAGGAAGAATTCTACAAGTTCATCAAG<br>CCGATCCTGGAAAAGATGGACGGAACAGAAGAACTGCTGGTCAAGCTGAACAGAGAA-<br>GACCTGCTGAGAAAGCAGAGAACATTCGACAACGGAA<br>GCATCCCGCACCAGATCCACCTGGGAGAACTGCACGCAATCCTGAGAAGACAGGAA-<br>GACTTCTACCCGTTCCTGAAGGACAACAGAGAAAAGAT<br>CGAAAAGATCCTGACATTCAGAATCCCGTACTACGTCGGACCGCTGGCAAGAG-<br>GAAACAGCAGATTCGCATGGATGACAAGAAAGAGCGAAGAA<br>ACAATCACACCGTGGAACTTCGAAGAAGTCGTCGACAAGGGAGCAAGCGCACAGAGCTT-<br>CATCGAAAGAATGACAAACTTCGACAAGAACCTGC<br>CGAACGAAAAGGTCCTGCCGAAGCACAGCCTGCTGTACGAATACTTCACAGTCTA-<br>CAACGAACTGACAAAGGTCAAGTACGTCACAGAAGGAAT<br>GAGAAAGCCGGCATTCCTGAGCGGAGAACAGAAGAAGGCAATCGTCGACCTGCTGTTCAA-<br>GACAAACAGAAAGGTCACAGTCAAGCAGCTGAAG<br>GAAGACTACTTCAAGAAGATCGAATGCTTCGACAGCGTCGAAATCAGCGGAGTCGAA-<br>GACAGATTCAACGCAAGCCTGGGAACATACCACGACC<br>TGCTGAAGATCATCAAGGACAAGGACTTCCTGGACAACGAAGAAAACGAAGACATCCTG-<br>GAAGACATCGTCCTGACACTGACACTGTTCGAAGA<br>CAGAGAAATGATCGAAGAAAGACTGAAGACATACGCACACCTGTTCGACGACAAGGTCAT-<br>GAAGCAGCTGAAGAGAAGAAGATACACAGGATGG<br>GGAAGACTGAGCAGAAAGCTGATCAACGGAATCAGAGACAAGCAGAGCGGAAA-<br>GACAATCCTGGACTTCCTGAAGAGCGACGGATTCGCAAACA<br>GAAACTTCATGCAGCTGATCCACGACGACAGCCTGACATTCAAGGAAGA-<br>CATCCAGAAGGCACAGGTCAGCGGACAGGGAGACAGCCTGCACGA<br>ACACATCGCAAACCTGGCAGGAAGCCCGGCAATCAAGAAGGGAATCCTGCAGACAGT-<br>CAAGGTCGTCGACGAACTGGTCAAGGTCATGGGAAGA<br>CACAAGCCGGAAAACATCGTCATCGAAATGGCAAGAGAAAACCA-<br>GACAACACAGAAGGGACAGAAGAACAGCAGAGAAAGAATGAAGAGAATCG<br>AAGAAGGAATCAAGGAACTGGGAAGCCAGATCCT-<br>GAAGGAACACCCGGTCGAAAACACACAGCTGCAGAACGAAAAGCTGTACCTGTACTACCT<br>GCAGAACGGAAGAGACATGTACGTCGACCAGGAACTGGACATCAACAGACTGAGCGAC-<br>TACGACGTCGACCACATCGTCCCGCAGAGCTTCCTG<br>AAGGACGACAGCATCGACAACAAGGTCCTGACAAGAAGCGACAAGAACAGAG-<br>GAAAGAGCGACAACGTCCCGAGCGAAGAAGTCGTCAAGAAGA<br>TGAAGAACTACTGGAGACAGCTGCTGAACGCAAAGCTGAT-<br>CACACAGAGAAAGTTCGACAACCTGACAAAGGCAGAGAGGAGGACTGAGCGA<br>ACTGGACAAGGCAGGATTCATCAAGAGACAGCTGGTCGAAACAAGACAGAT-<br>CACAAAGCACGTCGCACAGATCCTGGACAGCAGAATGAACACA<br>AAGTACGACGAAAACGACAAGCTGATCAGAGAAGTCAAGGTCATCACACT-<br>GAAGAGCAAGCTGGTCAGCGACTTCAGAAAGGACTTCCAGTTCT<br>ACAAGGTCAGAGAAATCAACAACTACCACCACGCACACGACGCATACCT-<br>GAACGCAGTCGTCGGAACAGCACTGATCAAGAAGTACCCGAAGCT<br>GGAAAGCGAATTCGTCTACGGAGACTACAAGGTCTACGACGTCAGAAAGAT-<br>GATCGCAAAGAGCGAACAGGAAATCGGAAAGGCAACAGCAAAG<br>TACTTCTTCTACAGCAACATCATGAACTTCTTCAAGACAGAAATCACACTGGCAAACG-<br>GAGAAATCAGAAAGAGACCGCTGATCGAAACAAACG<br>GAGAAACAGGAGAAATCGTCTGGGACAAGGGAAGA-<br>GACTTCGCAACAGTCAGAAAGGTCCTGAGCATGCCGCAGGTCAACATCGTCAAGAAGAC<br>AGAAGTCCGACAGGAGGAT-<br>TCAGCAAGGAAAGCATCCTGCCGAAGAGAAACAGCGACAAGCTGATCGCAAGAAAGAAGGACTGGGACCCGAAG<br>AAGTACGGAGGATTCGACAGCCCGACAGTCGCATA-<br>CAGCGTCCTGGTCGTCGCAAAGGTCGAAAAGGGAAAGAGCAAGAAGCTGAAGAGCGTCA<br>AGGAACTGCTGGGAATCACAATCATGGAAAGAAGCAGCTTCGAAAAGAACCC-<br>GATCGACTTCCTGGAAGCAAAGGGATACAAGGAAGTCAAGAA<br>GGACCTGATCATCAAGCTGCCGAAGTACAGCCTGTTCGAACTGGAAAACG-<br>GAAGAAAGAGAATGCTGGCAAGCGCAGGAGAACTGCAGAAGGGA<br>AACGAACTGGCACTGCCGAGCAAGTACGTCAACTTCCTGTACCTGGCAAGCCAC-<br>TACGAAAAGCTGAAGGGAAGCCCGGAAGACAACGAACAGA<br>AGCAGCTGTTCGTCGAACAGCACAAGCACTACCTGGACGAAATCATCGAACA-<br>GATCAGCGAATTCAGCAAGAGAGTCATCCTGGCAGACGCAAA<br>CCTGGACAAGGTCCTGAGCGCATACAACAAGCACAGAGACAAGCC-<br>GATCAGAGAACAGGCAGAAAACATCATCCACCTGTTCACACTGACAAAC<br>CTGGGAGCACCGGCAGCATTCAAGTACTTCGACACAACAATCGACAGAAAGAGATA-<br>CACAAGCACAAAGGAAGTCCTGGACGCAACACTGATCC<br>ACCAGAGCATCACAGGACTGTACGAAACAAGAATCGACCTGAGCCAGCTGGGAGGAGACG-<br>GAGGAGGAAGCCAGGCAGCAAAGAGAAGCAGAAC<br>AACA | |
| Open read- | GACAAGAAGTACAGCATCGGACTGGACATCGGAACAAACAGCGTCGGATGGGCAGTCAT-<br>CACAGACGAATACAAGGTCCCGAGCAAGAAGTTCA<br>AGGTCCTGGGAAACACAGACAGACACAGCATCAAGAAGAACCTGATCG-<br>GAGCACTGCTGTTCGACAGCGGAGAAACAGCAGAAGCAACAAGACT | 167 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| ing frame for Cas9 with NLS3 (no start or stop codons; suitable for inclusion in fusion protein coding sequence) | GAAGAGAACAGCAAGAAGAAGATACACAAGAAGAAAGAACAGAATCTGCTACCTGCAG-GAAATCTTCAGCAACGAAATGGCAAAGGTCGACGAC<br>AGCTTCTTCCACAGACTGGAAGAAAGCTTCCTGGTCGAAGAAGACAAGAAGCACGAAA-GACACCCGATCTTCGGAAACATCGTCGACGAAGTCG<br>CATACCACGAAAAGTACCCGACAATCTACCACCTGAGAAAGAAGCTGGTCGACAGCACA-GACAAGGCAGACCTGAGACTGATCTACCTGGCACT<br>GGCACACATGATCAAGTTCAGAGGACACTTCCTGATCGAAGGAGACCT-GAACCCGGACAACAGCGACGTCGACAAGCTGTTCATCCAGCTGGTC<br>CAGACATACAACCAGCTGTTCGAAGAAAACCCGATCAACGCAAGCG-GAGTCGACGCAAAGGCAATCCTGAGCGCAAGACTGAGCAAGAGCAGAA<br>GACTGGAAAACCTGATCGCACAGCTGCCGGGAGAAAAGAAGAACGGACTGTTCG-GAAACCTGATCGCACTGAGCCTGGGACTGACACCGAACTT<br>CAAGAGCAACTTCGACCTGGCAGAAGACGCAAAGCTGCAGCTGAGCAAGGACACAT-ACGACGACGACCTGGACAACCTGCTGGCACAGATCGGA<br>GACCAGTACGCAGACCTGTTCCTGGCAGCAAAGAACCTGAGCGACGCAATCCTGCT-GAGCGACATCCTGAGAGTCAACACAGAAATCACAAAGG<br>CACCGCTGAGCGCAAGCATGATCAAGAGATACGACGAACAC-CACCAGGACCTGACACTGCTGAAGGCACTGGTCAGACAGCAGCTGCCGGAAAA<br>GTACAAGGAAATCTTCTTCGACCAGAGCAAGAACGGATACGCAGGATACATCGACGGAG-GAGCAAGCCAGGAAGAATTCTACAAGTTCATCAAG<br>CCGATCCTGGAAAAGATGGACGGAACAGAAGAACTGCTGGTCAAGCTGAACAGAGAA-GACCTGCTGAGAAAGCAGAGAACATTCGACAACGGAA<br>GCATCCCGCACCAGATCCACCTGGGAGAACTGCACGCAATCCTGAGAAGACAGGAA-GACTTCTACCCGTTCCTGAAGGACAACAGAGAAAAGAT<br>CGAAAAGATCCTGACATTCAGAATCCCGTACTACGTCGGACCGCTGGCAAGAG-GAAACAGCAGATTCGCATGGATGACAAGAAAGAGCGAAGAA<br>ACAATCACACCGTGGAACTTCGAAGAAGTCGTCGACAAGGGAGCAAGCGCACAGAGCTT-CATCGAAAGAATGACAAACTTCGACAAGAACCTGC<br>CGAACGAAAAGGTCCTGCCGAAGCACAGCCTGCTGTACGAATACTTCACAGTCTA-CAACGAACTGACAAAGGTCAAGTACGTCACAGAAGGAAT<br>GAGAAAGCCGGCATTCCTGAGCGGAGAACAGAAGAAGGCAATCGTCGACCTGCTGTTCAA-GACAAACAGAAAGGTCACAGTCAAGCAGCTGAAG<br>GAAGACTACTTCAAGAAGATCGAATGCTTCGACAGCGTCGAAATCAGCGGAGTCGAA-GACAGATTCAACGCAAGCCTGGGAACATACCACGACC<br>TGCTGAAGATCATCAAGGACAAGGACTTCCTGGACAACGAAGAAAACGAAGACATCCTG-GAAGACATCGTCCTGACACTGACACTGTTCGAAGA<br>CAGAGAAATGATCGAAGAAAGACTGAAGACATACGCACACCTGTTCGACGACAAGGTCAT-GAAGCAGCTGAAGAGAAGAAGATACACAGGATGG<br>GGAAGACTGAGCAGAAAGCTGATCAACGGAATCAGAGACAAGCAGAGCGGAAA-GACAATCCTGGACTTCCTGAAGAGCGACGGATTCGCAAACA<br>GAAACTTCATGCAGCTGATCCACGACGACAGCCTGACATTCAAGGAAGA-CATCCAGAAGGCACAGGTCAGCGGACAGGGAGACAGCCTGCACGA<br>ACACATCGCAAACCTGGCAGGAAGCCCGGCAATCAAGAAGGGAATCCTGCAGACAGT-CAAGGTCGTCGACGAACTGGTCAAGGTCATGGGAAGA<br>CACAAGCCGGAAAACATCGTCATCGAAATGGCAAGAGAAAACCA-GACAACACAGAAGGGACAGAAGAACAGCAGAGAAAGAATGAAGAAATCG<br>AAGAAGGAATCAAGGAACTGGGAAGCCAGATCCT-GAAGGAACACCCGGTCGAAAACACACAGCTGCAGAACGAAAAGCTGTACCTGTACTACCT<br>GCAGAACGGAAGAGACATGTACGTCGACCAGGAACTGGACATCAACAGACTGAGCGAC-TACGACGTCGACCACATCGTCCCGCAGAGCTTCCTG<br>AAGGACGACAGCATCGACAACAAGGTCCTGACAAGAAGCGACAAGAACAGAG-GAAAGAGCGACAACGTCCCGAGCGAAGAAGTCGTCAAGAAGA<br>TGAAGAACTACTGGAGACAGCTGCTGAACGCAAAGCTGAT-CACACAGAGAAAGTTCGACAACCTGACAAAGGCAGAGAGGAGGACTGAGCGA<br>ACTGGACAAGGCAGGATTCATCAAGAGACAGCTGGTCGAAACAAGACAGAT-CACAAAGCACGTCGCACAGATCCTGGACAGCAGAATGAACACA<br>AAGTACGACGAAAACGACAAGCTGATCAGAGAAGTCAAGGTCATCACACT-GAAGAGCAAGCTGGTCAGCGACTTCAGAAAGGACTTCCAGTTCT<br>ACAAGGTCAGAGAAATCAACAACTACCACCACGCACACGACGCATACCT-GAACGCAGTCGTCGGAACAGCACTGATCAAGAAGTACCCGAAGCT<br>GGAAAAGCGAATTCGTCTACGGAGACTACAAGGTCTACGACGTCAGAAAGAT-GATCGCAAAGAGCGAACAGGAAATCGGAAAGGCAACAGCAAAG<br>TACTTCTTCTACAGCAACATCATGAACTTCTTCAAGACAGAAATCACACTGGCAAACG-GAGAAATCAGAAAGAGACCGCTGATCGAAACAAACG<br>GAGAAACAGGAGAAATCGTCTGGGACAAGGGAAGA-GACTTCGCAACAGTCAGAAAGGTCCTGAGCATGCCGCAGGTCAACATCGTCAAGAAGAC<br>AGAAGTCCAGACAGGAGGAT-TCAGCAAGGAAAGCATCCTGCCGAAGAGAAACAGCGACAAGCTGATCGCAAGAAAGAAGGACTGGGACCCGAAG<br>AAGTACGGAGGATTCGACAGCCCGACAGTCGCATA-CAGCGTCCTGGTCGTCGCAAAGGTCGAAAAGGGAAAGAGCAAGAAGCTGAAGAGCGTCA<br>AGGAACTGCTGGGAATCACAATCATGGAAAGAAGCAGCTTCGAAAAGAACCC-GATCGACTTCCTGGAAGCAAAGGGATACAAGGAAGTCAAGAA<br>GGACCTGATCATCAAGCTGCCGAAGTACAGCCTGTTCGAACTGGAAAACG-GAAGAAAGAGAATGCTGGCAAGCGCAGGAGAACTGCAGAAGGGA<br>AACGAACTGGCACTGCCGAGCAAGTACGTCAACTTCCTGTACCTGGCAAGCCAC-TACGAAAAGCTGAAGGGAAGCCCGGAAGACAACGAACAGA | |

| Description | Sequence | SEQ ID No. |
|---|---|---|
| | AGCAGCTGTTCGTCGAACAGCACAAGCACTACCTGGACGAAATCATCGAACA-<br>GATCAGCGAATTCAGCAAGAGAGTCATCCTGGCAGACGCAAA<br>CCTGGACAAGGTCCTGAGCGCATACAACAAGCACAGAGACAAGCC-<br>GATCAGAGAACAGGCAGAAAACATCATCCACCTGTTCACACTGACAAAC<br>CTGGGAGCACCCGGCAGCATTCAAGTACTTCGACACAACAATCGACAGAAAGAGATA-<br>CACAAGCACAAAGGAAGTCCTGGACGCAACACTGATCC<br>ACCGAGCATCACAGGACTGTACGAAACAAGAATCGACCTGAGCCAGCTGGGAGGAGACG-<br>GAGGAGGAAGCCCGGCACCGGCAAAGAGAGAAAG<br>AACAACA | |
| Open reading frame for Cas9 with NLS4 (no start or stop codons; suitable for inclusion in fusion protein coding sequence) | GACAAGAAGTACAGCATCGGACTGGACATCGGAACAAACAGCGTCGGATGGGCAGTCAT-<br>CACAGACGAATACAAGGTCCCGAGCAAGAAGTTCA<br>AGGTCCTGGGAAACACAGACAGACACAGCATCAAGAAGAACCTGATCG-<br>GAGCACTGCTGTTCGACAGCGGAGAAACAGCAGAAGCAACAAGACT<br>GAAGAGAACAGCAAGAAGAAGATACAAGAAGAAAGAACAGAATCTGCTACCTGCAG-<br>GAAATCTTCAGCAACGAAATGGCAAAGGTCGACGAC<br>AGCTTCTTCCACAGACTGGAAGAAAGCTTCCTGGTCGAAGAAGACAAGAAGCACGAAA-<br>GACACCCGATCTTCGGAAACATCGTCGACGAAGTCG<br>CATACCACGAAAAGTACCCGACAATCTACCACCTGAGAAAGAAGCTGGTCGACAGCACA-<br>GACAAGGCAGACCTGAGACTGATCTACCTGGCACT<br>GGCACACATGATCAAGTTCAGAGGACACTTCCTGATCGAAGGAGACCT-<br>GAACCCGGACAACAGCGACGTCGACAAGCTGTTCATCCAGCTGGTC<br>CAGACATACAACCAGCTGTTCGAAGAAAACCCGATCAACGCAAGCG-<br>GAGTCGACGCAAAGGCAATCCTGAGCGCAAGACTGAGCAAGAGCAGAA<br>GACTGGAAAACCTGATCGCACAGCTGCCGGGAGAAAAGAAGAACGGACTGTTCG-<br>GAAACCTGATCGCACTGAGCCTGGGACTGACACCGAACTT<br>CAAGAGCAACTTCGACCTGGCAGAAGACGCAAAGCTGCAGCTGAGCAAGGACACAT-<br>ACGACGACGACCTGGACAACCTGCTGGCACAGATCGGA<br>GACCAGTACGCAGACCTGTTCCTGGCAGCAAAGAACCTGAGCGACGCAATCCTGCT-<br>GAGCGACATCCTGAGAGTCAACACAGAAATCACAAAGG<br>CACCGCTGAGCGCAAGCATGATCAAGAGATACGACGAACAC-<br>CACCAGGACCTGACACTGCTGAAGGCACTGGTCAGACAGCAGCTGCCGGAAAA<br>GTACAAGGAAATCTTCTTCGACCAGAGCAAGAACGGATACGCAGGATACATCGACGGAG-<br>GAGCAAGCCAGGAAGAATTCTACAAGTTCATCAAG<br>CCGATCCTGGAAAAGATGGACGGAACAGAAGAACTGCTGGTCAAGCTGAACAGAGAA-<br>GACCTGCTGAGAAAGCAGAGACATTCGACAACGGAA<br>GCATCCCGCACCAGATCCACCTGGGAGAACTGCACGCAATCCTGAGAAGACAGGAA-<br>GACTTCTACCCGTTCCTGAAGGACAACAGAGAAAAGAT<br>CGAAAAGATCCTGACATTCAGAATCCCGTACTACGTCGGACCGCTGGCAAGAG-<br>GAAACAGCAGATTCGCATGGATGACAAGAAAGAGCGAAGAA<br>ACAATCACACCGTGGAACTTCGAAGAAGTCGTCGACAAGGGAGCAAGCGCACAGAGCTT-<br>CATCGAAAGAATGACAAACTTCGACAAGAACCTGC<br>CGAACGAAAAGGTCCTGCCGAAGCACAGCCTGCTGTACGAATACTTCACAGTCTA-<br>CAACGAACTGACAAAGGTCAAGTACGTCACAGAAGGAAT<br>GAGAAAGCCGGCATTCCTGAGCGGAGAACAGAAGAAGGCAATCGTCGACCTGCTGTTCAA-<br>GACAAACAGAAAGGTCACAGTCAAGCAGCTGAAG<br>GAAGACTACTTCAAGAAGATCGAATGCTTCGACAGCGTCGAAATCAGCGGAGTCGAA-<br>GACAGATTCAACGCAAGCCTGGGAACATACCACGACC<br>TGCTGAAGATCATCAAGGACAAGGACTTCCTGGACAACGAAGAAAACGAAGACATCCTG-<br>GAAGACATCGTCCTGACACTGACACTGTTCGAAGA<br>CAGAGAAATGATCGAAGAAAGACTGAAGACATACGCACACCTGTTCGACGACAAGGTCAT-<br>GAAGCAGCTGAAGAGAAGAAGATACAGGATGG<br>GGAAGACTGAGCAGAAAGCTGATCAACGGAATCAGAGACAAGCAGAGCGGAAA-<br>GACAATCCTGGACTTCCTGAAGAGCGACGGATTCGCAAACA<br>GAAACTTCATGCAGCTGATCCACGACGACAGCCTGACATTCAAGGAAGA-<br>CATCCAGAAGGCACAGGTCAGCGGACAGGGAGACAGCCTGCACGA<br>ACACATCGCAAACCTGGCAGGAAGCCCGGCAATCAAGAAGGGAATCCTGCAGACAGT-<br>CAAGGTCGTCGACGAACTGGTCAAGGTCATGGGAAGA<br>CACAAGCCGGAAAACATCGTCATCGAAATGGCAAGAGAAAACCA-<br>GACAACACAGAAGGGACAGAAGAACAGCAGAGAAAGAATGAAGAAATCG<br>AAGAAGGAATCAAGGAACTGGGAAGCCAGATCCT-<br>GAAGGAACACCCGGTCGAAAACACACAGCTGCAGAACGAAAAGCTGTACCTGTACTACCT<br>GCAGAACGGAAGAGACATGTACGTCGACCAGGAACTGGACATCAACAGACTGAGCGAC-<br>TACGACGTCGACCACATCGTCCCGCAGAGCTTCCTG<br>AAGGACGACAGCATCGACAACAAGGTCCTGACAAGAAGCGACAAGAACAGAG-<br>GAAAGAGCGACAACGTCCCGAGCGAAGAAGTCGTCAAGAAGA<br>TGAAGAACTACTGGAGACAGCTGCTGAACGCAAAGCTGAT-<br>CACACAGAGAAAGTTCGACAACCTGACAAAGGCAGAGAGGAGGACTGAGCGA<br>ACTGGACAAGGCAGGATTCATCAAGAGACAGCTGGTCGAAACAGACAGAT-<br>CACAAAGCACGTCGCACAGATCCTGGACAGCAGAATGAACACA<br>AAGTACGACGAAAACGACAAGCTGATCAGAGAAGTCAAGGTCATCACACT-<br>GAAGAGCAAGCTGGTCAGCGACTTCAGAAAGGACTTCCAGTTCT<br>ACAAGGTCAGAGAAATCAACAACTACCACCACGCACACGACGCATACCT-<br>GAACGCAGTCGTCGGAACAGCACTGATCAAGAAGTACCCGAAGCT<br>GGAAAGCGAATTCGTCTACGGAGACTACAAGGTCTACGACGTCAGAAAGAT-<br>GATCGCAAAGAGCGAACAGGAAATCGGAAAGGCAACAGCAAAG | 168 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | TACTTCTTCTACAGCAACATCATGAACTTCTTCAAGACAGAAATCACACTGGCAAACG-<br>GAGAAATCAGAAAGAGACCGCTGATCGAAACAAACG<br>GAGAAACAGGAGAAATCGTCTGGGACAAGGGAAGA-<br>GACTTCGCAACAGTCAGAAAGGTCCTGAGCATGCCGCAGGTCAACATCGTCAAGAAGAC<br>AGAAGTCCAGACAGGAGGAT-<br>TCAGCAAGGAAAGCATCCTGCCGAAGAGAAACAGCGACAAGCTGATCGCAAGAAAGAAGGACTGGGACCCGAAG<br>AAGTACGGAGGATTCGACAGCCCGACAGTCGCATA-<br>CAGCGTCCTGGTCGTCGCAAAGGTCGAAAAGGGAAAGAGCAAGAAGCTGAAGAGCGTCA<br>AGGAACTGCTGGGAATCACAATCATGGAAAGAAGCAGCTTCGAAAAGAACCC-<br>GATCGACTTCCTGGAAGCAAAGGGATACAAGGAAGTCAAGAA<br>GGACCTGATCATCAAGCTGCCGAAGTACAGCCTGTTCGAACTGGAAAACG-<br>GAAGAAAGAGAATGCTGGCAAGCGCAGGAGAACTGCAGAAGGGA<br>AACGAACTGGCACTGCCGAGCAAGTACGTCAACTTCCTGTACCTGGCAAGCCAC-<br>TACGAAAAGCTGAAGGGAAGCCCGGAAGACAACGAACAGA<br>AGCAGCTGTTCGTCGAACAGCACAAGCACTACCTGGACGAAATCATCGAACA-<br>GATCAGCGAATTCAGCAAGAGAGTCATCCTGGCAGACGCAAA<br>CCTGGACAAGGTCCTGAGCGCATACAACAAGCACAGAGACAAGCC-<br>GATCAGAGAACAGGCAGAAAACATCATCCACCTGTTCACACTGACAAAC<br>CTGGGAGCACCGGCAGCATTCAAGTACTTCGACACAACAATCGACAGAAAGAGATA-<br>CACAAGCACAAAGGAAGTCCTGGACGCAACACTGATCC<br>ACCAGAGCATCACAGGACTGTACGAAACAAGAATCGACCTGAGCCAGCTGGGAGGAGACG-<br>GAGGAGGAAGCCAGGCAGCAAAGAGACCGAGAAC<br>AACA | |
| Open reading frame for Cas9 with NLS5 (no start or stop codons; suitable for inclusion in fusion protein coding sequence) | GACAAGAAGTACAGCATCGGACTGGACATCGGAACAAACAGCGTCGGATGGGCAGTCAT-<br>CACAGACGAATACAAGGTCCCGAGCAAGAAGTTCA<br>AGGTCCTGGGAAACACAGACAGACACAGCATCAAGAAGAACCTGATCG-<br>GAGCACTGCTGTTCGACAGCGGAGAAACAGCAGAAGCAACAAGACT<br>GAAGAGAACAGCAAGAAGAAGATACACAAGAAGAAAGAACAGAATCTGCTACCTGCAG-<br>GAAATCTTCAGCAACGAAATGGCAAAGGTCGACGAC<br>AGCTTCTTCCACAGACTGGAAGAAAGCTTCCTGGTCGAAGAAGACAAGAAGCACGAAA-<br>GACACCCGATCTTCGGAAACATCGTCGACGAAGTCG<br>CATACCACGAAAAGTACCCGACAATCTACCACCTGAGAAAGAAGCTGGTCGACAGCACA-<br>GACAAGGCAGACCTGAGACTGATCTACCTGGCACT<br>GGCACACATGATCAAGTTCAGAGGACACTTCCTGATCGAAGGAGACCT-<br>GAACCCGGACAACAGCGACGTCGACAAGCTGTTCATCCAGCTGGTC<br>CAGACATACAACCAGCTGTTCGAAGAAAACCCGATCAACGCAAGCG-<br>GAGTCGACGCAAAGGCAATCCTGAGCGCAAGACTGAGCAAGAGCAGAA<br>GACTGGAAAACCTGATCGCACAGCTGCCGGGAGAAAAGAAGAACGGACTGTTCG-<br>GAAACCTGATCGCACTGAGCCTGGGACTGACACCGAACTT<br>CAAGAGCAACTTCGACCTGGCAGAAGACGCAAAGCTGCAGCTGAGCAAGGACACAT-<br>ACGACGACGACCTGGACAACCTGCTGGCACAGATCGGA<br>GACCAGTACGCAGACCTGTTCCTGGCAGCAAAGAACCTGAGCGACGCAATCCTGCT-<br>GAGCGACATCCTGAGAGTCAACACAGAAATCACAAAGG<br>CACCGCTGAGCGCAAGCATGATCAAGAGATACGACGAACAC-<br>CACCAGGACCTGACACTGCTGAAGGCACTGGTCAGACAGCAGCTGCCGGAAAA<br>GTACAAGGAAATCTTCTTCGACCAGAGCAAGAACGGATACGCAGGATACATCGACGGAG-<br>GAGCAAGCCAGGAAGAATTCTACAAGTTCATCAAG<br>CCGATCCTGGAAAAGATGGACGGAACAGAAGAACTGCTGGTCAAGCTGAACAGAGAA-<br>GACCTGCTGAGAAAGCAGAGAACATTCGACAACGGAA<br>GCATCCCGCACCAGATCCACCTGGGAGAACTGCACGCAATCCTGAGAAGACAGGAA-<br>GACTTCTACCCGTTCCTGAAGGACAACAGAGAAAAGAT<br>CGAAAAGATCCTGACATTCAGAATCCCGTACTACGTCGGACCGCTGGCAAGAG-<br>GAAACAGCAGATTCGCATGGATGACAAGAAAGAGCGAAGAA<br>ACAATCACACCGTGGAACTTCGAAGAAGTCGTCGACAAGGGAGCAAGCGCACAGAGCTT-<br>CATCGAAAGAATGACAAACTTCGACAAGAACCTGC<br>CGAACGAAAAGGTCCTGCCGAAGCACAGCCTGCTGTACGAATACTTCACAGTCTA-<br>CAACGAACTGACAAAGGTCAAGTACGTCACAGAAGGAAT<br>GAGAAAGCCGGCATTCCTGAGCGGAGAACAGAAGAAGGCAATCGTCGACCTGCTGTTCAA-<br>GACAAACAGAAAGGTCACAGTCAAGCAGCTGAAG<br>GAAGACTACTTCAAGAAGATCGAATGCTTCGACAGCGTCGAAATCAGCGGAGTCGAA-<br>GACAGATTCAACGCAAGCCTGGGAACATACCACGACC<br>TGCTGAAGATCATCAAGGACAAGGACTTCCTGGACAACGAAGAAAACGAAGACATCCTG-<br>GAAGACATCGTCCTGACACTGACACTGTTCGAAGA<br>CAGAGAAATGATCGAAGAAAGACTGAAGACATACGCACACCTGTTCGACGACAAGGTCAT-<br>GAAGCAGCTGAAGAGAAGAAGATACACAGGATGG<br>GGAAGACTGAGCAGAAAGCTGATCAACGGAATCAGAGACAAGCAGAGCGGAAA-<br>GACAATCCTGGACTTCCTGAAGAGCGACGGATTCGCAAACA<br>GAAACTTCATGCAGCTGATCCACGACGACGCCTGACATTCAAGGAAGA-<br>CATCCAGAAGGCACAGGTCAGCGGACAGGGAGACAGCCTGCACGA<br>ACACATCGCAAACCTGGCAGGAAGCCCGGCAATCAAGAAGGGAATCCTGCAGACAGT-<br>CAAGGTCGTCGACGAACTGGTCAAGGTCATGGGAAGA<br>CACAAGCCGGAAAACATCGTCATCGAAATGGCAAGAGAAAACCA-<br>GACAACACAGAGGGACAGAAGAACAGCAGAGAAAGAATGAAGAGAATCG<br>AAGAAGGAATCAAGGAACTGGGAAGCCAGATCCT-<br>GAAGGAACACCCGGTCGAAAACACACAGCTGCAGAACGAAAAGCTGTACCTGTACTACCT | 169 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | GCAGAACGGAAGAGACATGTACGTCGACCAGGAACTGGACATCAACAGACTGAGCGAC-<br>TACGACGTCGACCACATCGTCCCGCAGAGCTTCCTG<br>AAGGACGACAGCATCGACAACAAGGTCCTGACAAGAAGCGACAAGAACAGAG-<br>GAAAGAGCGACAACGTCCCGAGCGAAGAAGTCGTCAAGAAGA<br>TGAAGAACTACTGGAGACAGCTGCTGAACGCAAAGCTGAT-<br>CACACAGAGAAAGTTCGACAACCTGACAAAGGCAGAGAGAGGAGGACTGAGCGA<br>ACTGGACAAGGCAGGATTCATCAAGAGACAGCTGGTCGAAACAAGACAGAT-<br>CACAAAGCACGTCGCACAGATCCTGGACAGCAGAATGAACACA<br>AAGTACGACGAAAACGACAAGCTGATCAGAGAAGTCAAGGTCATCACACT-<br>GAAGAGCAAGCTGGTCAGCGACTTCAGAAAGGACTTCCAGTTCT<br>ACAAGGTCAGAGAAATCAACAACTACCACCACGCACACGACGCATACCT-<br>GAACGCAGTCGTCGGAACAGCACTGATCAAGAAGTACCCGAAGCT<br>GGAAAGCGAATTCGTCTACGGAGACTACAAGGTCTACGACGTCAGAAAGAT-<br>GATCGCAAAGAGCGAACAGGAAATCGGAAGGCAACAGCAAAG<br>TACTTCTTCTACAGCAACATCATGAACTTCTTCAAGACAGAAATCACACTGGCAAACG-<br>GAGAAATCAGAAGAGACCGCTGATCGAAACAAACG<br>GAGAAACAGGAGAAATCGTCTGGGACAAGGGAAGA-<br>GACTTCGCAACAGTCAGAAAGGTCCTGAGCATGCCGCAGGTCAACATCGTCAAGAAGAC<br>AGAAGTCCAGACAGGAGGAT-<br>TCAGCAAGGAAAGCATCCTGCCGAAGAGAAACAGCGACAAGCTGATCGCAAGAAAGAAGGACTGGGACCCGAAG<br>AAGTACGGAGGATTCGACAGCCCGACAGTCGCATA-<br>CAGCGTCCTGGTCGTCGCAAAGGTCGAAAAGGGAAAGAGCAAGAAGCTGAAGAGCGTCA<br>AGGAACTGCTGGGAATCACAATCATGGAAAGAAGCAGCTTCGAAAAGAACCC-<br>GATCGACTTCCTGGAAGCAAAGGGATACAAGGAAGTCAAGAA<br>GGACCTGATCATCAAGCTGCCGAAGTACAGCCTGTTCGAACTGGAAAACG-<br>GAAGAAAGAGAATGCTGGCAAGCGCAGGAGAACTGCAGAAGGGA<br>AACGAACTGGCACTGCCGAGCAAGTACGTCAACTTCCTGTACCTGGCAAGCCAC-<br>TACGAAAAGCTGAAGGGAAGCCCGGAAGACAACGAACAGA<br>AGCAGCTGTTCGTCGAACAGCACAAGCACTACCTGGACAAATCATCGAACA-<br>GATCAGCGAATTCAGCAAGAGAGTCATCCTGGCAGACGCAAA<br>CCTGGACAAGGTCCTGAGCGCATACAACAAGCACAGAGACAAGCC-<br>GATCAGAGAACAGGCAGAAAACATCATCCACCTGTTCACACTGACAAAC<br>CTGGGAGCACCGGCAGCATTCAAGTACTTCGACACAACAATCGACAGAAAGAGATA-<br>CACAAGCACAAAGGAAGTCCTGGACGCAACACTGATCC<br>ACCAGAGCATCACAGGACTGTACGAAACAAGAATCGACCTGAGCCAGCTGGGAGGAGACG-<br>GAGGAGGAAGCAGAGCAGCAAAGAGACCGAGAAC<br>AACA | |
| Open reading frame for Cas9 with NLS6 (no start or stop codons; suitable for inclusion in | GACAAGAAGTACAGCATCGGACTGGACATCGGAACAAACAGCGTCGGATGGGCAGTCAT-<br>CACAGACGAATACAAGGTCCCGAGCAAGAAGTTCA<br>AGGTCCTGGGAAACACAGACAGACACAGCATCAAGAAGAACCTGATCG-<br>GAGCACTGCTGTTCGACAGCGGAGAAACAGCAGAAGCAACAAGACT<br>GAAGAGAACAGCAAGAAGAAGATACACAAGAAGAAAGAACAGAATCTGCTACCTGCAG-<br>GAAATCTTCAGCAACGAAATGGCAAAGGTCGACGAC<br>AGCTTCTTCCACAGACTGGAAGAAAGCTTCCTGGTCGAAGAAGACAAGAAGCACGAAA-<br>GACACCCGATCTTCGGAAACATCGTCGACGAAGTCG<br>CATACCACGAAAAGTACCCGACAATCTACCACCTGAGAAAGAAGCTGGTCGACAGCACA-<br>GACAAGGCAGACCTGAGACTGATCTACCTGGCACT<br>GGCACACATGATCAAGTTCAGAGGACACTTCCTGATCGAAGGAGACCT-<br>GAACCCGGACAACAGCGACGTCGACAAGCTGTTCATCCAGCTGGTC<br>CAGACATACAACCAGCTGTTCGAAGAAAACCCGATCAACGCAAGCG-<br>GAGTCGACGCAAAGGCAATCCTGAGCGCAAGACTGAGCAAGAGCAGAA<br>GACTGGAAAACCTGATCGCACAGCTGCCGGGAGAAAAGAAGAACGGACTGTTCG-<br>GAAACCTGATCGCACTGAGCCTGGGACTGACACCGAACTT<br>CAAGAGCAACTTCGACCTGGCAGAAGACGCAAAGCTGCAGCTGAGCAAGGACACAT-<br>ACGACGACGACCTGGACAACCTGCTGGCACAGATCGGA<br>GACCAGTACGCAGACCTGTTCCTGGCAGCAAAGAACCTGAGCGACGCAATCCTGCT-<br>GAGCGACATCCTGAGAGTCAACACAGAAATCACAAAGG<br>CACCGCTGAGCGCAAGCATGATCAAGAGATACGACGAACAC-<br>CACCAGGACCTGACACTGCTGAAGGCACTGGTCAGACAGCAGCTGCCGGAAAA<br>GTACAAGGAAATCTTCTTCGACCAGAGCAAGAACGGATACGCAGGATACATCGACGGAG-<br>GAGCAAGCCAGGAAGAATTCTACAAGTTCATCAAG<br>CCGATCCTGGAAAAGATGGACGGAACAGAAGAACTGCTGGTCAAGCTGAACAGAGAA-<br>GACCTGCTGAGAAAGCAGAGAACATTCGACAACGGAA<br>GCATCCCGCACCAGATCCACCTGGGAGAACTGCACGCAATCCTGAGAAGACAGGAA-<br>GACTTCTACCCGTTCCTGAAGGACAACAGAGAAAAGAT<br>CGAAAAGATCCTGACATTCAGAATCCCGTACTACGTCGGACCGCTGGCAAGAG-<br>GAAACAGCAGATTCGCATGGATGACAAGAAAGAGCGAAGAA<br>ACAATCACACCGTGGAACTTCGAAGAAGTCGTCGACAAGGGAGCAAGCGCACAGAGCTT-<br>CATCGAAAGAATGACAAACTTCGACAAGAACCTGC<br>CGAACGAAAAGGTCCTGCCGAAGCACAGCCTGCTGTACGAATACTTCACAGTCTA-<br>CAACGAACTGACAAAGGTCAAGTACGTCACAGAAGGAAT<br>GAGAAAGCCGGCATTCCTGAGCGGAGAACAGAAGAAGGCAATCGTCGACCTGCTGTTCAA-<br>GACAAACAGAAAGGTCACAGTCAAGCAGCTGAAG<br>GAAGACTACTTCAAGAAGATCGAATGCTTCGACAGCGTCGAAATCAGCGGAGTCGAA-<br>GACAGATTCAACGCAAGCCTGGGAACATACCACGACC | 170 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| fusion protein coding sequence) | TGCTGAAGATCATCAAGGACAAGGACTTCCTGGACAACGAAGAAAACGAAGACATCCTG-GAAGACATCGTCCTGACACTGACACTGTTCGAAGACAGAGAAATGATCGAAGAAAGACTGAAGACATACGCACACCTGTTCGACGACAAGGTCAT-GAAGCAGCTGAAGAGAAGAAGATACACAGGATGGGGAAGACTGAGCAGAAAGCTGATCAACGGAATCAGAGACAAGCAGAGCGGAAA-GACAATCCTGGACTTCCTGAAGAGCGACGGATTCGCAAACAGAAACTTCATGCAGCTGATCCACGACGACAGCCTGACATTCAAGGAAGA-CATCCAGAAGGCACAGGTCAGCGGACAGGGAGACAGCCTGCACGAACACATCGCAAACCTGGCAGGAAGCCCGGCAATCAAGAAGGGAATCCTGCAGACAGT-CAAGGTCGTCGACGAACTGGTCAAGGTCATGGGAAGACACAAGCCGGAAAACATCGTCATCGAAATGGCAAGAGAAAACCA-GACAACACAGAAGGGACAGAAGAACAGCAGAGAAAGAATGAAGAGAATCGAAGAAGGAATCAAGGAACTGGGAAGCCAGATCCT-GAAGGAACACCCGGTCGAAAACACACAGCTGCAGAACGAAAAGCTGTACCTGTACTACCTGCAGAACGGAAGAGACATGTACGTCGACCAGGAACTGGACATCAACAGACTGAGCGAC-TACGACGTCGACCACATCGTCCCGCAGAGCTTCCTGAAGGACGACAGCATCGACAACAAGGTCCTGACAAGAAGCGACAAGAACAGAG-GAAAGAGCGACAACGTCCCGAGCGAAGAAGTCGTCAAGAAGATGAAGAACTACTGGAGACAGCTGCTGAACGCAAAGCTGAT-CACACAGAGAAAGTTCGACAACCTGACAAAGGCAGAGAGAGGAGGACTGAGCGAACTGGACAAGGCAGGATTCATCAAGAGACAGCTGGTCGAAACAAGACAGAT-CACAAAGCACGTCGCACAGATCCTGGACAGCAGAATGAACACAAAGTACGACGAAAACGACAAGCTGATCAGAGAAGTCAAGGTCATCACACT-GAAGAGCAAGCTGGTCAGCGACTTCAGAAAGGACTTCCAGTTCTACAAGGTCAGAGAAATCAACAACTACCACCACGCACACGACGCATACCT-GAACGCAGTCGTCGGAACAGCACTGATCAAGAAGTACCCGAAGCTGGAAAAGCGAATTCGTCTACGGAGACTACAAGGTCTACGACGTCAGAAAGAT-GATCGCAAAGAGCGAACAGGAAATCGGAAAGGCAACAGCAAAGTACTTCTTCTACAGCAACATCATGAACTTCTTCAAGACAGAAATCACACTGGCAAACG-GAGAAATCAGAAAGAGACCGCTGATCGAAACAAACGGAGAAACAGGAGAAATCGTCTGGGACAAGGGAAGA-GACTTCGCAACAGTCAGAAAGGTCCTGAGCATGCCGCAGGTCAACATCGTCAAGAAGACAGAAGTCCAGACAGGAGGAT-TCAGCAAGGAAAGCATCCTGCCGAAGAGAAACAGCGACAAGCTGATCGCAAGAAAGAAGGACTGGGACCCGAAGAAGTACGGAGGATTCGACAGCCCGACAGTCGCATA-CAGCGTCCTGGTCGTCGCAAAGGTCGAAAAGGGAAAGAGCAAGAAGCTGAAGAGCGTCAAGGAACTGCTGGGGAATCACAATCATGGAAAGAAGCAGCTTCGAAAAGAACCC-GATCGACTTCCTGGAAGCAAAGGGATACAAGGAAGTCAAGAAGGACCCTGATCATCAAGCTGCCGAAGTACAGCCTGTTCGAACTGGAAAACG-GAAGAAAGAGAATGCTGGCAAGCGCAGGAGAACTGCAGAAGGGAAACGAACTGGCACTGCCGAGCAAGTACGTCAACTTCCTGTACCTGGCAAGCCAC-TACGAAAAGCTGAAGGGAAGCCCGGAAGACAACGAACAGAAGCAGCTGTTCGTCGAACAGCACAAGCACTACCTGGACGAAATCATCGAACA-GATCAGCGAATTCAGCAAGAGAGTCATCCTGGCAGACGCAAACCTGGACAAGGTCCTGAGCGCATACAACAAGCACAGAGACAAGCC-GATCAGAGAACAGGCAGAAAACATCATCCACCTGTTCACACTGACAAACCTGGGAGCACCGGCAGCATTCAAGTACTTCGACACAACAATCGACAGAAAGAGATA-CACAAGCACAAAGGAAGTCCTGGACGCAACACTGATCCACCAGAGCATCACAGGACTGTACGAAACAAGAATCGACCTGAGCCAGCTGGGAGGAGACG-GAGGAGGAAGCGCAGCAGCAAAGAGAAGCTGGAGCATGGCAGCA | |
| Open reading frame for Cas9 with NLS7 (no start or stop | GACAAGAAGTACAGCATCGGACTGGACATCGGAACAAACAGCGTCGGATGGGCAGTCAT-CACAGACGAATACAAGGTCCCGAGCAAGAAGTTCAAGGTCCTGGGAAACACAGACAGACACAGCATCAAGAAGAACCTGATCG-GAGCACTGCTGTTCGACAGCGGAGAAACAGCAGAAGCAACAAGACTGAAGAGAACAGCAAGAAGAAGATACACAAGAAGAAAGAACAGAATCTGCTACCTGCAG-GAAATCTTCAGCAACGAAATGGCAAAGGTCGACGACAGCTTCTTCCACAGACTGGAAGAAAGCTTCCTGGTCGAAGAAGACAAGAAGCACGAAA-GACACCCGATCTTCGGAAACATCGTCGACGAAGTCGCATACCACGAAAAGTACCCGACAATCTACCACCTGAGAAAGAAGCTGGTCGACAGCACA-GACAAGGCAGACCTGAGACTGATCTACCTGGCACTGGCACACATGATCAAGTTCAGAGGACACTTCCTGATCGAAGGAGACCT-GAACCCGGACAACAGCGACGTCGACAAGCTGTTCATCCAGCTGGTCCAGACATACAACCAGCTGTTCGAAGAAAACCCGATCAACGCAAGCG-GAGTCGACGCAAAGGCAATCCTGAGCGCAAGACTGAGCAAGAGCAGAAGACTGGAAACCTGATCGCACAGCTGCCGGGAGAAAAGAAGAACGGACTGTTCG-GAAACCTGATCGCACTGAGCCTGGGACTGACACCGAACTTCAAGAGCAACTTCGACCTGGCAGAAGACGCAAAGCTGCAGCTGAGCAAGGACACAT-ACGACGACGACCTGGACAACCTGCTGGCACAGATCGGAGACCAGTACGCAGACCTGTTCCTGGCAGCAAAGAACCTGAGCGACGCAATCCTGCT-GAGCGACATCCTGAGAGTCAACACAGAAATCACAAAGGCACCGCTGAGCGCAAGCATGATCAAGAGATACGACGAACAC-CACCAGGACCTGACACTGCTGAAGGCACTGGTCAGACAGCAGCTGCCGGAAAAGTACAAGGAAATCTTCTTCGACCAGAGCAAGAACGGATACGCAGGATACATCGACGGAG-GAGCAAGCCAGGAAGAATTCTACAAGTTCATCAAG | 171 |

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| codons; suitable for inclusion in fusion protein coding sequence) | CCGATCCTGGAAAAGATGGACGGAACAGAAGAACTGCTGGTCAAGCTGAACAGAGAA-GACCTGCTGAGAAAGCAGAGAACATTCGACAACGGAA GCATCCCGCACCAGATCCACCTGGGAGAACTGCACGCAATCCTGAGAAGACAGGAA-GACTTCTACCCGTTCCTGAAGGACAACAGAGAAAAGAT CGAAAAGATCCTGACATTCAGAATCCCGTACTACGTCGGACCGCTGGCAAGAG-GAAACAGCAGATTCGCATGGATGACAAGAAAGAGCGAAGAA ACAATCACACCGTGGAACTTCGAAGAAGTCGTCGACAAGGGAGCAAGCGCACAGAGCTT-CATCGAAAGAATGACAAACTTCGACAAGAACCTGC CGAACGAAAAGGTCCTGCCGAAGCACAGCCTGCTGTACGAATACTTCACAGTCTA-CAACGAACTGACAAAGGTCAAGTACGTCACAGAAGGAAT GAGAAAGCCGGCATTCCTGAGCGGAGAACAGAAGAAGGCAATCGTCGACCTGCTGTTCAA-GACAAACAGAAAGGTCACAGTCAAGCAGCTGAAG GAAGACTACTTCAAGAAGATCGAATGCTTCGACAGCGTCGAAATCAGCGGAGTCGAA-GACAGATTCAACGCAAGCCTGGGAACATACCACGACC TGCTGAAGATCATCAAGGACAAGGACTTCCTGGACAACGAAGAAAACGAAGCATCCTG-GAAGACATCGTCCTGACACTGACACTGTTCGAAGA CAGAGAAATGATCGAAGAAAGACTGAAGACATACGCACACCTGTTCGACGACAAGGTCAT-GAAGCAGCTGAAGAGAAGAAGATACAGGATGG GGAAGACTGAGCAGAAAGCTGATCAACGGAATCAGAGACAAGCAGAGCGGAAA-GACAATCCTGGACTTCCTGAAGAGCGACGGATTCGCAAACA GAAACTTCATGCAGCTGATCCACGACGACAGCCTGACATTCAAGGAAGA-CATCCAGAAGGCACAGGTCAGCGGACAGGGAGACAGCCTGCACGA ACACATCGCAAACCTGGCAGGAAGCCCGGCAATCAAGAAGGGAATCCTGCAGACAGT-CAAGGTCGTCGACGAACTGGTCAAGGTCATGGGAAGA CACAAGCCGGAAAACATCGTCATCGAAATGGCAAGAGAAAACCA-GACAACACAGAAGGGACAGAAGAACAGCAGAGAAAGAATGAAGAAATCG AAGAAGGAATCAAGGAACTGGGAAGCCAGATCCT-GAAGGAACACCCGGTCGAAAACACACAGCTGCAGAACGAAAAGCTGTACCTGTACTACCT GCAGAACGGAAGAGACATGTACGTCGACCAGGAACTGGACATCAACAGACTGAGCGAC-TACGACGTCGACCACATCGTCCCGCAGAGCTTCCTG AAGGACGACAGCATCGACAACAAGGTCCTGACAAGAAGCGACAAGAACAGAG-GAAAGAGCGACAACGTCCCGAGCGAAGAAGTCGTCAAGAAGA TGAAGAACTACTGGAGACAGCTGCTGAACGCAAAGCTGAT-CACACAGAGAAAGTTCGACAACCTGACAAAGGCAGAGAGAGGAGGACTGAGCGA ACTGGACAAGGCAGGATTCATCAAGAGACAGCTGGTCGAAACAAGACAGAT-CACAAAGCACGTCGCACAGATCCTGGACAGCAGAATGAACACA AAGTACGACGAAAACGACAAGCTGATCAGAGAAGTCAAGGTCATCACACT-GAAGAGCAAGCTGGTCAGCGACTTCAGAAAGGACTTCCAGTTCT ACAAGGTCAGAGAAATCAACAACTACCACCACGCACACGACGCATACCT-GAACGCAGTCGTCGGAACAGCACTGATCAAGAAGTACCCGAAGCT GGAAAGCGAATTCGTCTACGGAGACTACAAGGTCTACGACGTCAGAAAGAT-GATCGCAAAGAGCGAACAGGAAATCGGAAAGGCAACAGCAAAG TACTTCTTCTACAGCAACATCATGAACTTCTTCAAGACAGAAATCACACTGGCAAACG-GAGAAATCAGAAAGAGACCGCTGATCGAAACAAACG GAGAAACAGGAGAAATCGTCTGGGACAAGGGAAGA-GACTTCGCAACAGTCAGAAAGGTCCTGAGCATGCCGCAGGTCAACATCGTCAAGAAGAC AGAAGTCCAGACAGGAGGAT-TCAGCAAGGAAAGCATCCTGCCGAAGAGAAACAGCGACAAGCTGATCGCAAGAAAGAAGGACTGGGACCCGAAG AAGTACGGAGGATTCGACAGCCCGACAGTCGCATA-CAGCGTCCTGGTCGTCGCAAAGGTCGAAAAGGGAAAGAGCAAGAAGCTGAAGAGCGTCA AGGAACTGCTGGGAATCACAATCATGGAAAGAAGCAGCTTCGAAAAGAACCC-GATCGACTTCCTGGAAGCAAAGGGATACAAGGAAGTCAAGAA GGACCTGATCATCAAGCTGCCGAAGTACAGCCTGTTCGAACTGGAAAACG-GAAGAAAGAGAATGCTGGCAAGCGCAGGAGAACTGCAGAAGGGA AACGAACTGGCACTGCCGAGCAAGTACGTCAACTTCCTGTACCTGGCAAGCCAC-TACGAAAAGCTGAAGGGAAGCCCGGAAGACAACGAACAGA AGCAGCTGTTCGTCGAACAGCACAAGCACTACCTGGACGAAATCATCGAACA-GATCAGCGAATTCAGCAAGAGAGTCATCCTGGCAGACGCAAA CCTGGACAAGGTCCTGAGCGCATACAACAAGCACAGAGACAAGCC-GATCAGAGAACAGGCAGAAAACATCATCCACCTGTTCACACTGACAAAC CTGGGAGCACCGGCAGCATTCAAGTACTTCGACACAACAATCGACAGAAAGAGATA-CACAAGCACAAAGGAAGTCCTGGACGCAACACTGATCC ACCAGAGCATCACAGGACTGTACGAAACAAGAATCGACCTGAGCCAGCTGGGAGGAGACG-GAGGAGGAAGCGCAGCAGCAAAGAGAGTCTGGAG CATGGCATTC | |
| Open reading frame for | GACAAGAAGTACAGCATCGGACTGGACATCGGAACAAACAGCGTCGGATGGGCAGTCAT-CACAGACGAATACAAGGTCCCGAGCAAGAAGTTCA AGGTCCTGGGAAACACAGACAGACACGCATCAAGAAGAACCTGATCG-GAGCACTGCTGTTCGACAGCGGAGAAACAGCAGAAGCAACAAGACT GAAGAGAACAGCAAGAAGAAGATACAAGAAGAAAGAACAGAATCTGCTACCTGCAG-GAAATCTTCAGCAACGAAATGGCAAAGGTCGACGAC AGCTTCTTCCACAGACTGGAAGAAAGCTTCCTGGTCGAAGAAGACAAGAAGCACGAAAA-GACACCCGATCTTCGGAAACATCGTCGACGAAGTCG CATACCACGAAAAGTACCCGACAATCTACCACCTGAGAAAGAAGCTGGTCGACAGCACA-GACAAGGCAGACCTGAGACTGATCTACCTGGCACT | 172 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| Cas9 with NLS8 (no start or stop codons; suitable for inclusion in fusion protein coding sequence) | GGCACACATGATCAAGTTCAGAGGACACTTCCTGATCGAAGGAGACCT-GAACCCGGACAACAGCGACGTCGACAAGCTGTTCATCCAGCTGGTC CAGACATACAACCAGCTGTTCGAAGAAACCCGATCAACGCAAGCG-GAGTCGACGCAAAGGCAATCCTGAGCGCAAGACTGAGCAAGAGCAGAA GACTGGAAAACCTGATCGCACAGCTGCCGGGAGAAAAGAAGAACGGACTGTTCG-GAAACCTGATCGCACTGAGCCTGGGACTGACACCGAACTT CAAGAGCAACTTCGACCTGGCAGAAGACGCAAAGCTGCAGCTGAGCAAGGACACAT-ACGACGACGACCTGGACAACCTGCTGGCACAGATCGGA GACCAGTACGCAGACCTGTTCCTGGCAGCAAAGAACCTGAGCGACGCAATCCTGCT-GAGCGACATCCTGAGAGTCAACACAGAAATCACAAAGG CACCGCTGAGCGCAAGCATGATCAAGAGATACGACGAACAC-CACCAGGACCTGACACTGCTGAAGGCACTGGTCAGACAGCAGCTGCCGGAAAA GTACAAGGAAATCTTCTTCGACCAGAGCAAGAACGGATACGCAGGATACATCGACGGAG-GAGCAAGCCAGGAAGAATTCTACAAGTTCATCAAG CCGATCCTGGAAAAGATGGACGGAACAGAAGAACTGCTGGTCAAGCTGAACAGAGAA-GACCTGCTGAGAAAGCAGAGAACATTCGACAACGGAA GCATCCCGCACCAGATCCACCTGGGAGAACTGCACGCAATCCTGAGAAGACAGGAA-GACTTCTACCCGTTCCTGAAGGACAACAGAGAAAAGAT CGAAAAGATCCTGACATTCAGAATCCCGTACTACGTCGGACCGCTGGCAAGAG-GAAACAGCAGATTCGCATGGATGACAAGAAAGAGCGAAGAA ACAATCACACCGTGGAACTTCGAAGAAGTCGTCGACAAGGGAGCAAGCGCACAGAGCTT-CATCGAAAGAATGACAAACTTCGACAAGAACCTGC CGAACGAAAAGGTCCTGCCGAAGCACAGCCTGCTGTACGAATACTTCACAGTCTA-CAACGAACTGACAAAGGTCAAGTACGTCACAGAAGGAAT GAGAAAGCCGGCATTCCTGAGCGGAGAACAGAAGAAGGCAATCGTCGACCTGCTGTTCAA-GACAAACAGAAAGGTCACAGTCAAGCAGCTGAAG GAAGACTACTTCAAGAAGATCGAATGCTTCGACAGCGTCGAAATCAGCGGAGTCGAA-GACAGATTCAACGCAAGCCTGGGAACATACCACGACC TGCTGAAGATCATCAAGGACAAGGACTTCCTGGACAACGAAGAAAACGAAGACATCCTG-GAAGACATCGTCCTGACACTGACACTGTTCGAAGA CAGAGAAATGATCGAAGAAAGACTGAAGACATACGCACACCTGTTCGACGACAAGGTCAT-GAAGCAGCTGAAGAGAAGAAGATACACAGGATGG GGAAGACTGAGCAGAAAGCTGATCAACGGAATCAGAGACAAGCAGAGCGGAAA-GACAATCCTGGACTTCCTGAAGAGCGACGGATTCGCAAACA GAAACTTCATGCAGCTGATCCACGACGACAGCCTGACATTCAAGGAAGA-CATCCAGAAGGCACAGGTCAGCGGACAGGGAGACAGCCTGCACGA ACACATCGCAAACCTGGCAGGAAGCCCGGCAATCAAGAAGGGAATCCTGCAGACAGT-CAAGGTCGTCGACGAACTGGTCAAGGTCATGGGAAGA CACAAGCCGGAAAACATCGTCATCGAAATGGCAAGAGAAAACCA-GACAACACAGAAGGGACAGAAGAACAGCAGAGAAAGAATGAAGAGAATCG AAGAAGGAATCAAGGAACTGGGAAGCCAGATCCT-GAAGGAACACCCGGTCGAAAACACACAGCTGCAGAACGAAAAGCTGTACCTGTACTACCT GCAGAACGGAAGAGACATGTACGTCGACCAGGAACTGGACATCAACAGACTGAGCGAC-TACGACGTCGACCACATCGTCCCGCAGAGCTTCCTG AAGGACGACAGCATCGACAACAAGGTCCTGACAAGAAGCGACAAGAACAGAG-GAAAGAGCGACAACGTCCCGAGCGAAGAAGTCGTCAAGAAGA TGAAGAACTACTGGAGACAGCTGCTGAACGCAAAGCTGAT-CACACAGAGAAAGTTCGACAACCTGACAAAGGCAGAGAGAGGAGGACTGAGCGA ACTGGACAAGGCAGGATTCATCAAGAGACAGCTGGTCGAAACAAGACAGAT-CACAAAGCACGTCGCACAGATCCTGGACAGCAGAATGAACACA AAGTACGACGAAAACGACAAGCTGATCAGAGAAGTCAAGGTCATCACACT-GAAGAGCAAGCTGGTCAGCGACTTCAGAAAGGACTTCCAGTTCT ACAAGGTCAGAGAAATCAACAACTACCACCACGCACACGACGCATACCT-GAACGCAGTCGTCGGAACAGCACTGATCAAGAAGTACCCGAAGCT GGAAAAGCGAATTCGTCTACGGAGACTACAAGGTCTACGACGTCAGAAAGAT-GATCGCAAAGAGCGAACAGGAAATCGGAAAGGCAACAGCAAAG TACTTCTTCTACAGCAACATCATGAACTTCTTCAAGACAGAAATCACACTGGCAAACG-GAGAAATCAGAAAGAGACCGCTGATCGAAACAAACG GAGAAACAGGAGAAATCGTCTGGGACAAGGGAAGA-GACTTCGCAACAGTCAGAAAGGTCCTGAGCATGCCGCAGGTCAACATCGTCAAGAAGAC AGAAGTCCAGACAGGAGGAT-TCAGCAAGGAAAGCATCCTGCCGAAGAGAAACAGCGACAAGCTGATCGCAAGAAAGAAGGACTGGGACCCGAAG AAGTACGGAGGATTCGACAGCCCGACAGTCGCATA-CAGCGTCCTGGTCGTCGCAAAGGTCGAAAAGGGAAAGAGCAAGAAGCTGAAGAGCGTCA AGGAACTGCTGGGAATCACAATCATGGAAAGAAGCAGCTTCGAAAAGAACCC-GATCGACTTCCTGGAAGCAAAGGGATACAAGGAAGTCAAGAA GGACCTGATCATCAAGCTGCCGAAGTACAGCCTGTTCGAACTGGAAAACG-GAAGAAAGAGAATGCTGGCAAGCGCAGGAGAACTGCAGAAGGGA AACGAACTGGCACTGCCGAGCAAGTACGTCAACTTCCTGTACCTGGCAAGCCAC-TACGAAAAGCTGAAGGGAAGCCCGGAAGACAACGAACAGA AGCAGCTGTTCGTCGAACAGCACAAGCACTACCTGGACGAAATCATCGAACA-GATCAGCGAATTCAGCAAGAGAGTCATCCTGGCAGACGCAAA CCTGGACAAGGTCCTGAGCGCATACAACAAGCACAGAGACAAGCC-GATCAGAGAACAGGCAGAAAACATCATCCACCTGTTCACACTGACAAAC CTGGGAGCACCGGCAGCATTCAAGTACTTCGACAACAATCGACAGAAAGATA-CACAAGCACAAAGGAAGTCCTGGACGCAACACTGATCC |  |

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | ACCAGAGCATCACAGGACTGTACGAAACAAGAATCGACCTGAGCCAGCTGGGAGGAGACG-GAGGAGGAAGCGCAGCAGCAAAGAGAAGCTGGAGCATGGCATTC | |
| Open reading frame for Cas9 with NLS9 (no start or stop codons; suitable for inclusion in fusion protein coding sequence) | GACAAGAAGTACAGCATCGGACTGGACATCGGAACAAACAGCGTCGGATGGGCAGTCAT-CACAGACGAATACAAGGTCCCGAGCAAGAAGTTCA AGGTCCTGGGAAACACAGACAGACACAGCATCAAGAAGAACCTGATCG-GAGCACTGCTGTTCGACAGCGGAGAAACAGCAGAAGCAACAAGACT GAAGAGAACAGCAAGAAGAAGATACAAGAAGAAAGAACAGAATCTGCTACCTGCAG-GAAATCTTCAGCAACGAAATGGCAAAGGTCGACGAC AGCTTCTTCCACAGACTGGAAGAAAGCTTCCTGGTCGAAGAAGACAAGAAGCACGAAA-GACACCCGATCTTCGGAAACATCGTCGACGAAGTCG CATACCACGAAAAGTACCCGACAATCTACCACCTGAGAAAGAAGCTGGTCGACAGCACA-GACAAGGCAGACCTGAGACTGATCTACCTGGCACT GGCACACATGATCAAGTTCAGAGGACACTTCCTGATCGAAGGAGACCT-GAACCCGGACAACAGCGACGTCGACAAGCTGTTCATCCAGCTGGTC CAGACATACAACCAGCTGTTCGAAGAAAACCCGATCAACGCAAGCG-GAGTCGACGCAAAGGCAATCCTGAGCGCAAGACTGAGCAAGAGCAGAA GACTGGAAAACCTGATCGCACAGCTGCCGGGAGAAAAGAAGAACGGACTGTTCG-GAAACCTGATCGCACTGAGCCTGGGACTGACACCGAACTT CAAGAGCAACTTCGACCTGGCAGAAGACGCAAAGCTGCAGCTGAGCAAGGACACAT-ACGACGACGACCTGGACAACCTGCTGGCACAGATCGGA GACCAGTACGCAGACCTGTTCCTGGCAGCAAAGAACCTGAGCGACGCAATCCTGCT-GAGCGACATCCTGAGAGTCAACACAGAAATCACAAAGG CACCGCTGAGCGCAAGCATGATCAAGAGATACGACGAACAC-CACCAGGACCTGACACTGCTGAAGGCACTGGTCAGACAGCAGCTGCCGGAAAA GTACAAGGAAATCTTCTTCGACCAGAGCAAGAACGGATACGCAGGATACATCGACGGAG-GAGCAAGCCAGGAAGAATTCTACAAGTTCATCAAG CCGATCCTGGAAAAGATGGACGGAACAGAAGAACTGCTGGTCAAGCTGAACAGAGAA-GACCTGCTGAGAAAGCAGAGAACATTCGACAACGGAA GCATCCCGCACCAGATCCACCTGGGAGAACTGCACGCAATCCTGAGAAGACAGGAA-GACTTCTACCCGTTCCTGAAGGACAACAGAGAAAAGAT CGAAAAGATCCTGACATTCAGAATCCCGTACTACGTCGGACCGCTGGCAAGAG-GAAACAGCAGATTCGCATGGATGACAAGAAAGAGCGAAGAA ACAATCACACCGTGGAACTTCGAAGAAGTCGTCGACAAGGGAGCAAGCGCACAGAGCTT-CATCGAAAGAATGACAAACTTCGACAAGAACCTGC CGAACGAAAAGGTCCTGCCGAAGCACAGCCTGCTGTACGAATACTTCACAGTCTA-CAACGAACTGACAAAGGTCAAGTACGTCACAGAAGGAAT GAGAAAGCCGGCATTCCTGAGCGGAGAACAGAAGAAGGCAATCGTCGACCTGCTGTTCAA-GACAAACAGAAAGGTCACAGTCAAGCAGCTGAAG GAAGACTACTTCAAGAAGATCGAATGCTTCGACAGCGTCGAAATCAGCGGAGTCGAA-GACAGATTCAACGCAAGCCTGGGAACATACCACGACC TGCTGAAGATCATCAAGGACAAGGACTTCCTGGACAACGAAGAAAACGAAGACATCCTG-GAAGACATCGTCCTGACACTGACACTGTTCGAAGA CAGAGAAATGATCGAAGAAAGACTGAAGACATACGCACACCTGTTCGACGACAAGGTCAT-GAAGCAGCTGAAGAGAAGAAGATACACAGGATGG GGAAGACTGAGCAGAAAGCTGATCAACGGAATCAGAGACAAGCAGAGCGGAAA-GACAATCCTGGACTTCCTGAAGAGCGACGGATTCGCAAACA GAAACTTCATGCAGCTGATCCACGACGACAGCCTGACATTCAAGGAAGA-CATCCAGAAGGCACAGGTCAGCGGACAGGGAGACAGCCTGCACGA ACACATCGCAAACCTGGCAGGAAGCCCGGCAATCAAGAAGGGAATCCTGCAGACAGT-CAAGGTCGTCGACGAACTGGTCAAGGTCATGGGAAGA CACAAGCCGGAAAACATCGTCATCGAAATGGCAAGAGAAAACCA-GACAACACAGAAGGGACAGAAGAACAGCAGAGAAAGAATGAAGAGAATCG AAGAAGGAATCAAGGAACTGGGAAGCCAGATCCT-GAAGGAACACCCGGTCGAAAACACACAGCTGCAGAACGAAAAGCTGTACCTGTACTACCT GCAGAACGGAAGAGACATGTACGTCGACCAGGAACTGGACATCAACAGACTGAGCGAC-TACGACGTCGACCACATCGTCCCGCAGAGCTTCCTG AAGGACGACAGCATCGACAACAAGGTCCTGACAAGAAGCGACAAGAACAGAG-GAAAGAGCGACAACGTCCCGAGCGAAGAAGTCGTCAAGAAGA TGAAGAACTACTGGAGACAGCTGCTGAACGCAAAGCTGAT-CACACAGAGAAAGTTCGACAACCTGACAAAGGCAGAGAGGAGGACTGAGCGA ACTGGACAAGGCAGGATTCATCAAGAGACAGCTGGTCGAAACAAGACAGAT-CACAAAGCACGTCGCACAGATCCTGGACAGCAGAATGAACACA AAGTACGACGAAAACGACAAGCTGATCAGAGAAGTCAAGGTCATCACACT-GAAGAGCAAGCTGGTCAGCGACTTCAGAAAGGACTTCCAGTTCT ACAAGGTCAGAGAAATCAACAACTACCACCACGCACACGACGCATACCT-GAACGCAGTCGTCGGAACAGCACTGATCAAGAAGTACCCGAAGCT GGAAAGCGAATTCGTCTACGGAGACTACAAGGTCTACGACGTCAGAAAGAT-GATCGCAAAGAGCGAACAGGAAATCGGAAAGGCAACAGCAAAG TACTTCTTCTACAGCAACATCATGAACTTCTTCAAGACAGAAATCACACTGGCAAACG-GAGAAATCAGAAAGAGACCGCTGATCGAAACAAACG GAGAAACAGGAGAAATCGTCTGGGACAAGGGAAGA-GACTTCGCAACAGTCAGAAAGGTCCTGAGCATGCCGCAGGTCAACATCGTCAAGAAGAC AGAAGTCCAGACAGGAGGAT-TCAGCAAGGAAAGCATCCTGCCGAAGAGAAACAGCGACAAGCTGATCGCAAGAAAGAAGGACTGGGACCCGAAG | 173 |

| Description | Sequence | SEQ ID No. |
|---|---|---|
| | AAGTACGGAGGATTCGACAGCCCGACAGTCGCATA-<br>CAGCGTCCTGGTCGTCGCAAAGGTCGAAAAGGGAAAGAGCAAGAAGCTGAAGAGCGTCA<br>AGGAACTGCTGGGAATCACAATCATGGAAAGAAGCAGCTTCGAAAAGAACCC-<br>GATCGACTTCCTGGAAGCAAAGGGATACAAGGAAGTCAAGAA<br>GGACCTGATCATCAAGCTGCCGAAGTACAGCCTGTTCGAACTGGAAAACG-<br>GAAGAAAGAGAATGCTGGCAAGCGCAGGAGAACTGCAGAAGGGA<br>AACGAACTGGCACTGCCGAGCAAGTACGTCAACTTCCTGTACCTGGCAAGCCAC-<br>TACGAAAAGCTGAAGGGAAGCCCGGAAGACAACGAACAGA<br>AGCAGCTGTTCGTCGAACAGCACAAGCACTACCTGGACGAAATCATCGAACA-<br>GATCAGCGAATTCAGCAAGAGAGTCATCCTGGCAGACGCAAA<br>CCTGGACAAGGTCCTGAGCGCATACAACAAGCACAGAGACAAGCC-<br>GATCAGAGAACAGGCAGAAAACATCATCCACCTGTTCACACTGACAAAC<br>CTGGGAGCACCGGCAGCATTCAAGTACTTCGACACAACAATCGACAGAAAGAGATA-<br>CACAAGCACAAAGGAAGTCCTGGACGCAACACTGATCC<br>ACCAGAGCATCACAGGACTGTACGAAACAAGAATCGACCTGAGCCAGCTGGGAGGAGACG-<br>GAGGAGGAAGCGCAGCAGCAAAGAGAAAGTACTT<br>CGCAGCA | |
| Open reading frame for Cas9 with NLS10 (no start or stop codons; suitable for inclusion in fusion protein coding sequence) | GACAAGAAGTACAGCATCGGACTGGACATCGGAACAAACAGCGTCGGATGGGCAGTCAT-<br>CACAGACGAATACAAGGTCCCGAGCAAGAAGTTCA<br>AGGTCCTGGGAAACACAGACAGACACAGCATCAAGAAGAACCTGATCG-<br>GAGCACTGCTGTTCGACAGCGGAGAAACAGCAGAAGCAACAAGACT<br>GAAGAGAACAGCAAGAAGAAGATACACAAGAAGAAAGAACAGAATCTGCTACCTGCAG-<br>GAAATCTTCAGCAACGAAATGGCAAAGGTCGACGAC<br>AGCTTCTTCCACAGACTGGAAGAAAGCTTCCTGGTCGAAGAAGACAAGAAGCACGAAA-<br>GACACCCGATCTTCGGAAACATCGTCGACGAAGTCG<br>CATACCACGAAAAGTACCCGACAATCTACCACCTGAGAAAGAAGCTGGTCGACAGCACA-<br>GACAAGGCAGACCTGAGACTGATCTACCTGGCACT<br>GGCACACATGATCAAGTTCAGAGGACACTTCCTGATCGAAGGAGACCT-<br>GAACCCGGACAACAGCGACGTCGACAAGCTGTTCATCCAGCTGGTC<br>CAGACATACAACCAGCTGTTCGAAGAAAACCCGATCAACGCAAGCG-<br>GAGTCGACGCAAAGGCAATCCTGAGCGCAAGACTGAGCAAGAGCAGAA<br>GACTGGAAAACCTGATCGCACAGCTGCCGGGAGAAAAGAAGAACGGACTGTTCG-<br>GAAACCTGATCGCACTGAGCCTGGGACTGACACCGAACTT<br>CAAGAGCAACTTCGACCTGGCAGAAGACGCAAAGCTGCAGCTGAGCAAGGACACAT-<br>ACGACGACGACCTGGACAACCTGCTGGCACAGATCGGA<br>GACCAGTACGCAGACCTGTTCCTGGCAGCAAAGAACCTGAGCGACGCAATCCTGCT-<br>GAGCGACATCCTGAGAGTCAACACAGAAATCACAAAGG<br>CACCGCTGAGCGCAAGCATGATCAAGAGATACGACGAACAC-<br>CACCAGGACCTGACACTGCTGAAGGCACTGGTCAGACAGCAGCTGCCGGAAAA<br>GTACAAGGAAATCTTCTTCGACCAGAGCAAGAACGGATACGCAGGATACATCGACGGAG-<br>GAGCAAGCCAGGAAGAATTCTACAAGTTCATCAAG<br>CCGATCCTGGAAAAGATGGACGGAACAGAAGAACTGCTGGTCAAGCTGAACAGAGAA-<br>GACCTGCTGAGAAAGCAGAGAACATTCGACAACGGAA<br>GCATCCCGCACCAGATCCACCTGGGAGAACTGCACGCAATCCTGAGAAGACAGGAA-<br>GACTTCTACCCGTTCCTGAAGGACAACAGAGAAAAGAT<br>CGAAAAGATCCTGACATTCAGAATCCCGTACTACGTCGGACCGCTGGCAAGAG-<br>GAAACAGCAGATTCGCATGGATGACAAGAAAGAGCGAAGAA<br>ACAATCACACCGTGGAACTTCGAAGAAGTCGTCGACAAGGGAGCAAGCGCACAGAGCTT-<br>CATCGAAAGAATGACAAACTTCGACAAGAACCTGC<br>CGAACGAAAAGGTCCTGCCGAAGCACAGCCTGCTGTACGAATACTTCACAGTCTA-<br>CAACGAACTGACAAAGGTCAAGTACGTCACAGAAGGAAT<br>GAGAAAGCCGGCATTCCTGAGCGGAGAACAGAAGAAGGCAATCGTCGACCTGCTGTTCAA-<br>GACAAACAGAAAGGTCACAGTCAAGCAGCTGAAG<br>GAAGACTACTTCAAGAAGATCGAATGCTTCGACAGCGTCGAAATCAGCGGAGTCGAA-<br>GACAGATTCAACGCAAGCCTGGGAACATACCACGACC<br>TGCTGAAGATCATCAAGGACAAGGACTTCCTGGACAACGAAGAAAACGAAGACATCCTG-<br>GAAGACATCGTCCTGACACTGACACTGTTCGAAGA<br>CAGAGAAATGATCGAAGAAAGACTGAAGACATACGCACACCTGTTCGACGACAAGGTCAT-<br>GAAGCAGCTGAAGAGAAGAAGATACACAGGATGG<br>GGAAGACTGAGCAGAAAGCTGATCAACGGAATCAGAGACAAGCAGAGCGGAAA-<br>GACAATCCTGGACTTCCTGAAGAGCGACGGATTCGCAAACA<br>GAAACTTCATGCAGCTGATCCACGACGACAGCCTGACATTCAAGGAAGA-<br>CATCCAGAAGGCACAGGTCAGCGGACAGGGAGACAGCCTGCACGA<br>ACACATCGCAAACCTGGCAGGAAGCCCGGCAATCAAGAAGGGAATCCTGCAGACAGT-<br>CAAGGTCGTCGACGAACTGGTCAAGGTCATGGGAAGA<br>CACAAGCCGGAAAACATCGTCATCGAAATGGCAAGAGAAAACCA-<br>GACAACACAGAAGGGACAGAAGAACAGCAGAGAAAGAATGAAGAGAATCG<br>AAGAAGGAATCAAGGAACTGGGAAGCCAGATCCT-<br>GAAGGAACACCCGGTCGAAAACACACAGCTGCAGAACGAAAAGCTGTACCTGTACTACCT<br>GCAGAACGGAAGAGACATGTACGTCGACCAGGAACTGGACATCAACAGACTGAGCGAC-<br>TACGACGTCGACCACATCGTCCCGCAGAGCTTCCTG<br>AAGGACGACAGCATCGACAACAAGGTCCTGACAAGAAGCGACAAGAACAGAG-<br>GAAAGAGCGACAACGTCCCGAGCGAAGAAGTCGTCAAGAAGA<br>TGAAGAACTACTGGAGACAGCTGCTGAACGCAAAGCTGAT-<br>CACACAGAGAAAGTTCGACAACCTGACAAAGGCAGAGAGAGGAGGACTGAGCGA | 174 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | ACTGGACAAGGCAGGATTCATCAAGAGACAGCTGGTCGAAACAAGACAGAT-CACAAAGCACGTCGCACAGATCCTGGACAGCAGAATGAACACA AAGTACGACGAAAACGACAAGCTGATCAGAGAAGTCAAGGTCATCACACT-GAAGAGCAAGCTGGTCAGCGACTTCAGAAAGGACTTCCAGTTCT ACAAGGTCAGAGAAATCAACAACTACCACCACGCACACGACGCATACCT-GAACGCAGTCGTCGGAACAGCACTGATCAAGAAGTACCCGAAGCT GGAAAAGCGAATTCGTCTACGAGACTACAAGGTCTACGACGTCAGAAAGAT-GATCGCAAAGAGCGAACAGGAAATCGGAAAGGCAACAGCAAAG TACTTCTTCTACAGCAACATCATGAACTTCTTCAAGACAGAAATCACACTGGCAAACG-GAGAAATCAGAAAGAGACCGCTGATCGAAACAAACG GAGAAACAGGAGAAATCGTCTGGGACAAGGGAAGA-GACTTCGCAACAGTCAGAAAGGTCCTGAGCATGCCGCAGGTCAACATCGTCAAGAAGAC AGAAGTCCAGACAGGAGGAT-TCAGCAAGGAAAGCATCCTGCCGAAGAGAAACAGCGACAAGCTGATCGCAAGAAAGAAGGACTGGGACCCGAAG AAGTACGGAGGATTCGACAGCCCGACAGTCGCATA-CAGCGTCCTGGTCGTCGCAAAGGTCGAAAAGGGAAAGAGCAAGAAGCTGAAGAGCGTCA AGGAACTGCTGGGAATCACAATCATGGAAAGAAGCAGCTTCGAAAAGAACCC-GATCGACTTCCTGGAAGCAAAGGGATACAAGGAAGTCAAGAA GGACCTGATCATCAAGCTGCCGAAGTACAGCCTGTTCGAACTGGAAAACG-GAAGAAAGAGAATGCTGGCAAGCGCAGGAGAACTGCAGAAGGGA AACGAACTGGCACTGCCGAGCAAGTACGTCAACTTCCTGTACCTGGCAAGCCAC-TACGAAAAGCTGAAGGGAAGCCCGGAAGAACAACGAACAGA AGCAGCTGTTCGTCGAACAGCACAAGCACTACCTGGACGAAATCATCGAACA-GATCAGCGAATTCAGCAAGAGAGTCATCCTGGCAGACGCAAA CCTGGACAAGGTCCTGAGCGCATACAACAAGCACAGAGACAAGCC-GATCAGAGAACAGGCAGAAAACATCATCCACCTGTTCACACTGACAAAC CTGGGAGCACCGGCAGCATTCAAGTACTTCGACACAACAATCGACAGAAAGAGATA-CACAAGCACAAAGGAAGTCCTGGACGCAACACTGATCC ACCAGAGCATCACAGGACTGTACGAAACAAGAATCGACCTGAGCCAGCTGGGAGGAGACG-GAGGAGGAAGCAGAGCAGCAAAGAGAAAGGCATT CGCAGCA | |
| Open reading frame for Cas9 with NLS11 (no start or stop codons; suitable for inclusion in fusion protein coding | GACAAGAAGTACAGCATCGGACTGGACATCGGAACAAACAGCGTCGGATGGGCAGTCAT-CACAGACGAATACAAGGTCCCGAGCAAGAAGTTCA AGGTCCTGGGAAACACAGACAGACACAGCATCAAGAAGAACCTGATCG-GAGCACTGCTGTTCGACAGCGGAGAAACAGCAGAAGCAACAAGACT GAAGAGAACAGCAAGAAGAAGATACAAGGAAGAAAGAACAGAATCTGCTACCTGCAG-GAAATCTTCAGCAACGAAATGGCAAAGGTCGACGAC AGCTTCTTCCACAGACTGGAAGAAAGCTTCCTGGTCGAAGAAGACAAGAAGCACGAAA-GACACCCGATCTTCGGAAACATCGTCGACGAAGTCG CATACCACGAAAAGTACCCGACAATCTACCACCTGAGAAAGAAGCTGGTCGACAGCACA-GACAAGGCAGACCTGAGACTGATCTACCTGGCACT GGCACACATGATCAAGTTCAGAGGACACTTCCTGATCGAAGGAGACCT-GAACCCGGACAACAGCGACGTCGACAAGCTGTTCATCCAGCTGGTC CAGACATACAACCAGCTGTTCGAAGAAACCCGATCAACGCAAGCG-GAGTCGACGCAAAGGCAATCCTGAGCGCAAGACTGAGCAAGAGCAGAA GACTGGAAAACCTGATCGCACAGCTGCCGGGAGAAAAGAAGAACGGACTGTTCG-GAAACCTGATCGCACTGAGCCTGGGACTGACACCGAACTT CAAGAGCAACTTCGACCTGGCAGAAGACGCAAAGCTGCAGCTGAGCAAGGACACAT-ACGACGACGACCTGGACAACCTGCTGGCACAGATCGGA GACCAGTACGCAGACCTGTTCCTGGCAGCAAAGAACCTGAGCGACGCAATCCTGCT-GAGCGACATCCTGAGAGTCAACACAGAAATCACAAAGG CACCGCTGAGCGCAAGCATGATCAAGAGATACGACGAACAC-CACCAGGACCTGACACTGCTGAAGGCACTGGTCAGACAGCAGCTGCCGGAAAA GTACAAGGAAATCTTCTTCGACCAGAGCAAGAACGGATACGCAGGATACATCGACGGAG-GAGCAAGCCAGGAAGAATTCTACAAGTTCATCAAG CCGATCCTGGAAAAGATGGACGGAACAGAAGAACTGCTGGTCAAGCTGAACAGAGAA-GACCTGCTGAGAAAGCAGAGAACATTCGACAACGGAA GCATCCCGCACCAGATCCACCTGGGAGAACTGCACGCAATCCTGAGAAGACAGGAA-GACTTCTACCCGTTCCTGAAGGACAACAGAGAAAAGAT CGAAAAGATCCTGACATTCAGAATCCCGTACTACGTCGGACCGCTGGCAAGAG-GAAACAGCAGATTCGCATGGATGACAGAAAAGAGCGAAGAA ACAATCACACCGTGGAACTTCGAAGAAGTCGTCGACAAGGGAGCAAGCGCACAGAGCTT-CATCGAAAGAATGACAAACTTCGACAAGAACCTGC CGAACGAAAAGGTCCTGCCGAAGCACAGCCTGCTGTACGAATACTTCACAGTCTA-CAACGAACTGACAAAGGTCAAGTACGTCACAGAAGGAAT GAGAAAGCCGGCATTCCTGAGCGGAGAACAGAAGAAGGCAATCGTCGACCTGCTGTTCAA-GACAAACAGAAAGGTCACAGTCAAGCAGCTGAAG GAAGACTACTTCAAGAAGATCGAATGCTTCGACAGCGTCGAAATCAGCGGAGTCGAA-GACAGATTCAACGCAAGCCTGGGAACATACCACGACC TGCTGAAGATCATCAAGGACAAGGACTTCCTGGACAACGAAGAAAACGAAGACATCCTG-GAAGACATCGTCCTGACACTGACACTGTTCGAAGA CAGAGAAATGATCGAAGAAAGACTGAAGACATACGCACACCTGTTCGACGACAAGGTCAT-GAAGCAGCTGAAGAGAAGAAGATACACAGGATGG GGAAGACTGAGCAGAAAGCTGATCAACGGAATCAGAGACAAGCAGAGCGGAAA-GACAATCCTGGACTTCCTGAAGAGCGACGGATTCGCAAACA | 175 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| sequence_ | GAAACTTCATGCAGCTGATCCACGACGACAGCCTGACATTCAAGGAAGA-CATCCAGAAGGCACAGGTCAGCGGACAGGGAGACAGCCTGCACGA ACACATCGCAAACCTGGCAGGAAGCCCGGCAATCAAGAAGGGAATCCTGCAGACAGT-CAAGGTCGTCGACGAACTGGTCAAGGTCATGGGAAGA CACAAGCCGGAAAACATCGTCATCGAAATGGCAAGAGAAAACCA-GACAACACAGAAGGGACAGAAGAACAGCAGAGAAAGAATGAAGAGAATCG AAGAAGGAATCAAGGAACTGGGAAGCCAGATCCT-GAAGGAACACCCGGTCGAAAACACACAGCTGCAGAACGAAAAGCTGTACCTGTACTACCT GCAGAACGGAAGAGACATGTACGTCGACCAGGAACTGGACATCAACAGACTGAGCGAC-TACGACGTCGACCACATCGTCCCGCAGAGCTTCCTG AAGGACGACAGCATCGACAACAAGGTCCTGACAAGAAGCGACAAGAACAGAG-GAAAGAGCGACAACGTCCCGAGCGAAGAAGTCGTCAAGAAGA TGAAGAACTACTGGAGACAGCTGCTGAACGCAAAGCTGAT-CACACAGAGAAAGTTCGACAACCTGACAAAGGCAGAGAGGAGGACTGAGCGA ACTGGACAAGGCAGGATTCATCAAGAGACAGCTGGTCGAAACAAGACAGAT-CACAAAGCACGTCGCACAGATCCTGGACAGCAGAATGAACACA AAGTACGACGAAAACGACAAGCTGATCAGAGAAGTCAAGGTCATCACACT-GAAGAGCAAGCTGGTCAGCGACTTCAGAAAGGACTTCCAGTTCT ACAAGGTCAGAGAAATCAACAACTACCACCACGCACACGACGCATACCT-GAACGCAGTCGTCGGAACAGCACTGATCAAGAAGTACCCGAAGCT GGAAAGCGAATTCGTCTACGGAGACTACAAGGTCTACGACGTCAGAAAGAT-GATCGCAAAGAGCGAACAGGAAATCGGAAAGGCAACAGCAAAG TACTTCTTCTACAGCAACATCATGAACTTCTTCAAGACAGAAATCACACTGGCAAACG-GAGAAATCAGAAAGAGACCGCTGATCGAAACAAACG GAGAAACAGGAGAAATCGTCTGGGACAAGGGAAGA-GACTTCGCAACAGTCAGAAAGGTCCTGAGCATGCCGCAGGTCAACATCGTCAAGAAGAC AGAAGTCCAGACAGGAGGAT-TCAGCAAGGAAAGCATCCTGCCGAAGAGAAACAGCGACAAGCTGATCGCAAGAAAGAAGGACTGGGACCCGAAG AAGTACGGAGGATTCGACAGCCCGACAGTCGCATA-CAGCGTCCTGGTCGTCGCAAAGGTCGAAAAGGGAAAGAGCAAGAAGCTGAAGAGCGTCA AGGAACTGCTGGGAATCACAATCATGGAAAGAAGCAGCTTCGAAAAGAACCC-GATCGACTTCCTGGAAGCAAAGGGATACAAGGAAGTCAAGAA GGACCTGATCATCAAGCTGCCGAAGTACAGCCTGTTCGAACTGGAAAACG-GAAGAAAGAGAATGCTGGCAAGCGCAGGAGAACTGCAGAAGGGA AACGAACTGGCACTGCCGAGCAAGTACGTCAACTTCCTGTACCTGGCAAGCCAC-TACGAAAAGCTGAAGGGAAGCCCGGAAGACAACGAACAGA AGCAGCTGTTCGTCGAACAGCACAAGCACTACCTGGACGAAATCATCGAACA-GATCAGCGAATTCAGCAAGAGAGTCATCCTGGCAGACGCAAA CCTGGACAAGGTCCTGAGCGCATACAACAAGCACAGAGACAAGCC-GATCAGAGAACAGGCAGAAAACATCATCCACCTGTTCACACTGACAAAC CTGGGAGCACCGGCAGCATTCAAGTACTTCGACACAACAATCGACAGAAAGAGATA-CACAAGCACAAAGGAAGTCCTGGACGCAACACTGATCC ACCAGAGCATCACAGGACTGTACGAAACAAGAATCGACCTGAGCCAGCTGGGAGGAGACG-GAGGAGGAAGCAGAGCAGCAAAGAGAAAGTACTT CGCAGTC | |
| mRNA transcript with XBG UTRs and Cas9 ORF with low U 1 codons of Table | GGGAAGCUCAGAAUAAACGCUCAACUUUGGCCGGAUCUGCCACCAUGGACAAGAAGUA-CAGCAUCGGCUGGACAUCGGCACCAACAGCGUGGG CUGGGCCGUGAUCACCGACGAGUACAAGGUGCCCAGCAAGAAGUUCAAG-GUGCUGGGCAACACCGACAGACACAGCAUCAAGAAGAACCUGAUC GGCGCCCUGCUGUUCGACAGCGGCGAGACCGCCGAGGCCACCA-GACUGAAGAGAACCGCCAGAAGAAGAUACACCAGAAGAAAGAACAGAAUCU GCUACCUGCAGGAGAUCUUCAGCAACGAGAUGGCCAAGGUGGACGACAGCUUCUUCCACA-GACUGGAGGAGAGCUUCCUGGUGGAGGAGGACAA GAAGCACGAGAGACACCCCAUCUUCGGCAACAUCGUGGACGAGGUGGCCUACCACGAGA-AGUACCCCACCAUCUACCACCUGAGAAAGAAGCUG GUGGACAGCACCGACAAGGCCGACCUGAGACUGAUCUACCUGGCCCUGGCCCACAUGAU-CAAGUUCAGAGGCCACUUCCUGAUCGAGGGCGACC UGAACCCCGACAACAGCGACGUGGACAAGCUGUUCAUCCAGCUGGUGCAGACCUA-CAACCAGCUGUUCGAGGAGAACCCCAUCAACGCCAGCGG CGUGGACGCCAAGGCCAUCCUGAGCGCCAGACUGAGCAAGAGCAGAAGACUGGAGAAC-CUGAUCGCCCAGCUGCCCGGCGAGAAGAACGGC CUGUUCGGCAACCUGAUCGCCCUGAGCCUGGGCCUGACCCCCAACUUCAAGAGCAAC-UUCGACCUGGCCGAGGACGCCAAGCUGCAGCUGAGCA AGGACACCUACGACGACGACCUGGACAACCUGCUGGCCCAGAUCGGCGACC-AGUACGCCGACCUGUUCCUGGCCGCCAAGAACCUGAGCGACGC CAUCCUGCUGAGCGACAUCCUGAGAGUGAACACCGAGAUCACCAAGGCCCCC-CUGAGCGCCAGCAUGAUCAAGAGAUACGACGAGCACCACCAG GACCUGACCCUGCUGAAGGCCCUGGUGAGACAGCAGCUGCCCGAGAAGUACAAGGAGAUC-UUCUUCGACCAGAGCAAGAACGGCUACGCCGGCU ACAUCGACGGCGGCGCCAGCCAGGAGGAGUUCUACAAGUUCAUCAAGCCCAUCCUG-GAGAAGAUGGACGGCACCGAGGAGCUGCUGGUGAAGCU GAACAGAGAGGACCUGCUGAGAAAGCAGAGAACCUUCGACAACGGCAGCAUCCCC-CACCAGAUCCACCUGGGCGAGCUGCACGCCAUCCUGAGA AGACAGGAGGACUUCUACCCCUUCCUGAAGGACAACAGAGAGAAGAUCGAGAAGAUC-CUGACCUUCAGAAUCCCCUACUACGUGGGCCCCCUGG | 176 |

| Description | Sequence | SEQ ID No. |
|---|---|---|
| 4 | CCAGAGGCAACAGCAGAUUCGCCUGGAUGACCAGAAAGAGCGAGGAGACCAUCACCCC-<br>CUGGAACUUCGAGGAGGUGGUGGACAAGGGCGCCAG<br>CGCCCAGAGCUUCAUCGAGAGAAUGACCAACUUCGACAAGAACCUGCCCAACGAGAAG-<br>GUGCUGCCCAAGCACAGCCUGCUGUACGAGUACUUC<br>ACCGUGUACAACGAGCUGACCAAGGUGAAGUACGUGACCGAGGGCAUGAGAAAGCCCGCC-<br>UUCCUGAGCGGCGAGCAGAAGAAGGCCAUCGUGG<br>ACCUGCUGUUCAAGACCAACAGAAAGGUGACCGUGAAGCAGCUGAAGGAGGACUACUU-<br>CAAGAAGAUCGAGUGCUUCGACAGCGUGGAGAUCAG<br>CGGCGUGGAGGACAGAUUCAACGCCAGCCUGGGCACCUACCACGACCUGCUGAAGAUCAU-<br>CAAGGACAAGGACUUCCUGGACAACGAGGAGAAC<br>GAGGACAUCCUGGAGGACAUCGUGCUGACCCUGACCCU-<br>GUUCGAGGACAGAGAGAUGAUCGAGGAGAGACUGAAGACCUACGCCCACCUGUUCG<br>ACGACAAGGUGAUGAAGCAGCUGAAGAGAAGAAGAUACACCGGCUGGGGCA-<br>GACUGAGCAGAAAGCUGAACAACGGCAUCAGAGACAAGCAGAG<br>CGGCAAGACCAUCCUGGACUUCCUGAAGAGCGACGGCUUCGCCAACAGAAACUU-<br>CAUGCAGCUGAUCCACGACGACAGCCUGACCUUCAAGGAG<br>GACAUCCAGAAGGCCCAGGUGAGCGGCCAGGGCGACAGCCUGCACGAGCACAUCGCCAAC-<br>CUGGCCGGCAGCCCCGCCAUCAAGAAGGGCAUCC<br>UGCAGACCGUGAAGGUGGUGGACGAGCUGGUGAAGGUGAUGGGCA-<br>GACACAAGCCCGAGAACAUCGUGAUCGAGAUGGCCAGAGAGAACCAGAC<br>CACCCAGAAGGGCCAGAAGAACAGCAGAGAGAGAAUGAAGAGAAUCGAGGAGGGCAU-<br>CAAGGAGCUGGGCAGCCAGAUCCUGAAGGAGCACCCC<br>GUGGAGAACACCCAGCUGCAGAACGAGAAGCUGUACCUGUACUACCUGCAGAACGGCAGA-<br>GACAUGUACGUGGACCAGGAGCUGGACAUCAACA<br>GACUGAGCGACUACGACGUGGACCACAUCGUGCCCCAGAGCUUCCUGAAGGACGACAG-<br>CAUCGACAACAAGGUGCUGACCAGAAGCGACAAGAA<br>CAGAGGCAAGAGCGACAACGUGCCCAGCGAGGAGGUGGUGAAGAAGAUGAAGAACUACUG-<br>GAGACAGCUGCUGAACGCCAAGCUGAUCACCCAG<br>AGAAAGUUCGACAACCUGACCAAGGCCGAGAGAGGCGGC-<br>CUGAGCGAGCUGGACAAGGCCGGCUUCAUCAAGAGACAGCUGGUGGAGACCAGAC<br>AGAUCACCAAGCACGUGGCCCAGAUCCUGGACAGCAGAAUGAACACCA-<br>AGUACGACGAGAACGACAAGCUGAUCAGAGAGGUGAAGGUGAUCAC<br>CCUGAAGAGCAAGCUGGUGAGCGACUUCAGAAAGGACUUCCAGUUCUACAAG-<br>GUGAGAGAGAUCAACAACUACCACCACGCCCACGACGCCUAC<br>CUGAACGCCGUGGUGGGCACCGCCCUGAUCAAGAAGUACCCCAAGCUG-<br>GAGAGCGAGUUCGUGUACGGCGACUACAAGGUGUACGACGUGAGAA<br>AGAUGAUCGCCAAGAGCGAGCAGGAGAUCGGCAAGGCCACCGCCAAGUACUUCUUCUA-<br>CAGCAACAUCAUGAACUUCUUCAAGACCGAGAUCAC<br>CCUGGCCAACGGCGAGAUCAGAAAGAGACCCCUGAUCGAGACCAACGGCGA-<br>GACCGGCGAGAUCGUGUGGGACAAGGGCAGAGACUUCGCCACC<br>GUGAGAAAGGUGCUGAGCAUGCCCCAGGUGAACAUCGUGAAGAAGACCGAGGUGCA-<br>GACCGGCGGCUUCAGCAAGGAGCAUCCUGCCCAAGA<br>GAAACAGCGACAAGCUGAUCGCCAGAAAGAAGGACUGGGACCCCAAGAAGUACGGCGGC-<br>UUCGACAGCCCCACCGUGGCCUACAGCGUGCUGGU<br>GGUGGCCAAGGUGGAGAAGGGCAAGAGCAAGAAGCUGAAGAGCGUGAAGGAGCUGCUGGG-<br>CAUCACCAUCAUGGAGAGAAGCAGCUUCGAGAAG<br>AACCCCAUCGACUUCCUGGAGGCCAAGGGCUACAAGGAGGUGAAGAAGGACCUGAUCAU-<br>CAAGCUGCCCAAGUACAGCCUGUUCGAGCUGGAGA<br>ACGGCAGAAAGAGAAUGCUGGCCAGCGCCGGCGAGCUGCAGAAGGGCAACGAGCUGGCC-<br>CUGCCCAGCAAGUACGUGAACUUCCUGUACCUGGC<br>CAGCCACUACGAGAAGCUGAAGGGCAGCCCCGAGGACAACGAGCAGAAGCAGCU-<br>GUUCGUGGAGCAGCACAAGCACUACCUGGACGAGAUCAUC<br>GAGCAGAUCAGCGAGUUCAGCAAGAGAGUGAUCCUGGCCGACGCCAACCUGGACAAG-<br>GUGCUGAGCGCCUACAACAAGCACAGAGACAAGCCCA<br>UCAGAGAGCAGGCCGAGAACAUCAUCCACCUGUUCACCCUGACCAAC-<br>CUGGGCGCCCCCGCCGCCUUCAAGUACUUCGACACCACCAUCGACAG<br>AAAGAGAUACACCAGCACCAAGGAGGUGCUGGACGCCACCCUGAUCCACCAGAGCAU-<br>CACCGGCCUGUACGAGACCAGAAUCGACCUGAGCCAG<br>CUGGGCGGCGACGGCGGCGGCAGCCCCAAGAAGAAGAGAAAGGUGUGACUAGCACCAGC-<br>CUCAAGAACACCCGAAUGGAGUCUCUAACUACAU<br>AAUACCAACUUACACUUUACAAAAUGUUGUCCCCAAAAUGUAGCCAUUCGUAUCUGCUC-<br>CUAAUAAAAAGAAAGUUUCUUCACAUUCUCUCGA<br>GAAAAAAAAAAAAAAAAAAAAAAAAAAAAAAAAAAAAAAAAAAAAAAAAAAAAAAAAAAAAAAAAAAAAAAAAAAAAAAAAAAAAAAAAAAAAAA<br>UCUAG | |
| mRNA transcript with XBG | GGGAAGCUCAGAAUAAACGCUCAACUUUGGCCGGAUCUGCCACCAUGGACAAGAAGUA-<br>CUCCAUCGGCCUGGACAUCGGCACCAACUCCGUGGG<br>CUGGGCCGUGAUCACCGACGAGUACAAGGUGCCCUCCAAGAAGUUCAAG-<br>GUGCUGGGCAACACCGACCGGCACUCCAUCAAGAAGAACCUGAUC<br>GGCGCCCUGCUGUUCGACUCCGGCGAGACCGCCGAGGC-<br>CACCCGGCUGAAGCGGACCGCCCGGCGGCGGUACACCCGGCGGAAGAACCGGAUCU<br>GCUACCUGCAGGAGAUCUUCUCCAACGAGAUGGCCAAGGUGGACGACUCCUUCUUC-<br>CACCGGCUGGAGGAGUCCUUCCUGGUGGAGGAGGACAA<br>GAAGCACGAGCGGCACCCCAUCUUCGGCAACAUCGUGGACGAGGUGGCCUACCACGAGA-<br>AGUACCCCACCAUCUACCACCUGCGGAAGAAGCUG | 177 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| UTRs and Cas9 ORF with low A codons of Table 4 | GUGGACUCCACCGACAAGGCCGACCUGCGGCUGAUCUACCUGGCCCUGGCCCACAUGAU-CAAGUUCCGGGGCCACUUCCUGAUCGAGGGCGACC<br>UGAACCCCGACAACUCCGACGUGGACAAGCUGUUCAUCCAGCUGGUGCAGACCUA-CAACCAGCUGUUCGAGGAGAACCCCAUCAACGCCUCCGG<br>CGUGGACGCCAAGGCCAUCCUGUCCGCCCGGCUGUCCAAGUCCCGGCGGCUGGAGAAC-CUGAUCGCCCAGCUGCCCGGCGAGAAGAAGAACGGC<br>CUGUUCGGCAACCUGAUCGCCCUGUCCCUGGGCCUGACCCCCAACUUCAAGUCCAAC-UUCGACCUGGCCGAGGACGCCAAGCUGCAGCUGUCCA<br>AGGACACCUACGACGACGACCUGGACAACCUGCUGGCCCAGAUCGGCGACC-AGUACGCCGACCUGUUCCUGGCCGCCAAGAACCUGUCCGACGC<br>CAUCCUGCUGUCCGACAUCCUGCGGGUGAACACCGAGAUCACCAAGGCCCCCCUGUCCGC-CUCCAUGAUCAAGCGGUACGACGAGCACCACCAG<br>GACCUGACCCUGCUGAAGGCCCUGGUGCGGCAGCAGCUGCCCGAGAAGUACAAGGAGAUC-UUCUUCGACCAGUCCAAGAACGGCUACGCCGGCU<br>ACAUCGACGGCGGCGCCUCCCAGGAGGAGUUCUACAAGUUCAUCAAGCCCAUCCUG-GAGAAGAUGGACGGCACCGAGGAGCUGCUGGUGAAGCU<br>GAACCGGGAGGACCUGCUGCGGAAGCAGCGGACCUUCGACAACGGCUCCAUCCCC-CACCAGAUCCACCUGGGCGAGCUGCACGCCAUCCUGCGG<br>CGGCAGGAGGACUUCUACCCCUUCCUGAAGGACAACCGGGAGAAGAUCGAGAAGAUC-CUGACCUUCCGGAUCCCCUACUACGUGGGCCCCCUGG<br>CCCGGGGCAACUCCCGGUUCGCCUGGAUGACCCGGAAGUCCGAGGAGACCAUCACCCC-CUGGAACUUCGAGGAGGUGGUGGACAAGGGCGCCUC<br>CGCCCAGUCCUUCAUCGAGCGGAUGACCAACUUCGACAAGAACCUGCCCAACGAGAAG-GUGCUGCCCAAGCACUCCCUGCUGUACGAGUACUUC<br>ACCGUGUACAACGAGCUGACCAAGGUGAAGUACGUGACCGAGGGCAUGCGGAAGCCCGCC-UUCCUGUCCGGCGAGCAGAAGAAGGCCAUCGUGG<br>ACCUGCUGUUCAAGACCAACCGGAAGGUGACCGUGAAGCAGCUGAAGGAGGACUACUU-CAAGAAGAUCGAGUGCUUCGACUCCGUGGAGAUCUC<br>CGGCGUGGAGGACCGGUUCAACGCCUCCCUGGGCACCUACCACGACCUGCUGAAGAUCAU-CAAGGACAAGGACUUCCUGGACAACGAGGAGAAC<br>GAGGACAUCCUGGAGGACAUCGUGCUGACCCUGACCCUGUUCGAGGACCGG-GAGAUGAUCGAGGAGCGGCUGAAGACCUACGCCCACCUGUUCG<br>ACGACAAGGUGAUGAAGCAGCUGAAGCGGCGGCGGUACACCGGCUGGGGCCGGCUGU-CCCGGAAGCUGAUCAACGGCAUCCGGGACAAGCAGUC<br>CGGCAAGACCAUCCUGGACUUCCUGAAGUCCGACGGCUUCGCCAACCGGAACUU-CAUGCAGCUGAUCCACGACGACUCCCUGACCUUCAAGGAG<br>GACAUCCAGAAGGCCCAGGUGUCCGGCCAGGGCGACUCCCUGCACGAGCACAUCGCCAAC-CUGGCCGGCUCCCCCGCCAUCAAGAAGGGCAUCC<br>UGCAGACCGUGAAGGUGGUGGACGAGCUGGUGAAG-GUGAUGGGCCGGCACAAGCCCGAGAACAUCGUGAUCGAGAUGGCCCGGGAGAACCAGAC<br>CACCCAGAAGGGCCAGAAGAACUCCCGGGAGCGGAUGAAGCGGAUCGAGGAGGGCAU-CAAGGAGCUGGGCUCCCAGAUCCUGAAGGAGCACCCC<br>GUGGAGAACACCCAGCUGCAGAACGAGAAGCUGUACCUGUACUAC-CUGCAGAACGGCCGGGACAUGUACGUGGACCAGGAGCUGGACAUCAACC<br>GGCUGUCCGACUACGACGUGGACCACAUCGUGCCCCAGUCCUUCCUGAAGGACGACUC-CAUCGACAACAAGGUGCUGACCCGGUCCGACAAGAA<br>CCGGGGCAAGUCCGACAACGUGCCCUCCGAGGAGGUGGUGAAGAAGAUGAAGAACUA-CUGGCGGCAGCUGCUGAACGCCAAGCUGAUCACCCAG<br>CGGAAGUUCGACAACCUGACCAAGGCCGAGCGGGGCGGCCUGU-CCGAGCUGGACAAGGCCGGCUUCAUCAAGCGGCAGCUGGUGGAGACCCGGC<br>AGAUCACCAAGCACGUGGCCCAGAUCCUGGACUCCCGGAUGAACACCA-AGUACGACGAGAACGACAAGCUGAUCCGGGAGGUGAAGGUGAUCAC<br>CCUGAAGUCCAAGCUGGUGUCCGACUUCCGGAAGGACUUCCAGUUCUACAAGGUGCGG-GAGAUCAACAACUACCACCACGCCCACGACGCCUAC<br>CUGAACGCCGUGGUGGGCACCGCCCUGAUCAAGAAGUACCCCAAGCUGGAGU-CCGAGUUCGUGUACGGCGACUACAAGGUGUACGACGUGCGGA<br>AGAUGAUCGCCAAGUCCGAGCAGGAGAUCGGCAAGGCCACCGCCAAGUACUUCUUCUA-CUCCAACAUCAUGAACUUCUUCAAGACCGAGAUCAC<br>CCUGGCCAACGGCGAGAUCCGGAAGCGGCCCCUGAUCGAGACCAACGGCGA-GACCGGCGAGAUCGUGUGGGACAAGGGCCGGGACUUCGCCACC<br>GUGCGGAAGGUGCUGUCCAUGCCCCAGGUGAACAUCGUGAAGAAGACCGAGGUGCA-GACCGGCGGCUUCUCCAAGGAGUCCAUCCUGCCCAAGC<br>GGAACUCCGACAAGCUGAUCGCCCGGAAGAAGGACUGGGACCCCAAGAAGUACGGCGGC-UUCGACUCCCCCACCGUGGCCUACUCCGUGCUGGU<br>GGUGGCCAAGGUGGAGAAGGGCAAGUCCAAGAAGCUGAAGUCCGUGAAGGAGCUGCUGGG-CAUCACCAUCAUGGAGCGGUCCUCCUUCGAGAAG<br>AACCCCAUCGACUUCCUGGAGGCCAAGGGCUACAAGGAGGUGAAGAAGGACCUGAUCAU-CAAGCUGCCCAAGUACUCCCUGUUCGAGCUGGAGA<br>ACGGCCGGAAGCGGAUGCUGGCCUCCGCCGGCGAGCUGCAGAAGGGCAACGAGCUGGCC-CUGCCCUCCAAGUACGUGAACUUCCUGUACCUGGC<br>CUCCCACUACGAGAAGCUGAAGGGCUCCCCCGAGGACAACGAGCAGAAGCAGCU-GUUCGUGGAGCAGCACAAGCACUACCUGGACGAGAUCAUC<br>GAGCAGAUCUCCGAGUUCUCCAAGCGGGUGAUCCUGGCCGACGCCAACCUGGACAAG-GUGCUGUCCGCCUACAACAAGCACCGGGACAAGCCCA<br>UCCGGGAGCAGGCCGAGAACAUCAUCCACCUGUUCACCCUGACCAAC-CUGGGCGCCCCCGCCGCCUUCAAGUACUUCGACACCACCAUCGACCG | |

| Description | Sequence | SEQ ID No. |
|---|---|---|
| | GAAGCGGUACACCUCCACCAAGGAGGUGCUGGACGCCACCCUGAUCCACCAGUCCAU-<br>CACCGGCCUGUACGAGACCCGGAUCGACCUGUCCCAG<br>CUGGGCGGCGACGGCGGCGGCUCCCCCAAGAAGAAGCGGAAGGUGUGACUAGCACCAGC-<br>CUCAAGAACACCCGAAUGGAGUCUCUAAGCUACAU<br>AAUACCAACUUACACUUUACAAAAUGUUGUCCCCCAAAAUGUAGCCAUUCGUAUCUGCUC-<br>CUAAUAAAAAGAAAGUUUCUUCACAUUCUCUCGA<br>GAAAAAAAAAAAAAAAAAAAAAAAAAAAAAAAAAAAAAAAAAAAAAAAAAAAAAAAAAAAAAAAAAAAAAAAAAAAAAAAAAAAAAAAAAAAAA<br>UCUAG | |
| mRNA<br>trans-<br>cript<br>with<br>XBG<br>UTRs<br>and<br>Cas9<br>ORF<br>with<br>low<br>U/A<br>codons<br>of<br>Table<br>4 | GGGAAGCUCAGAAUAAACGCUCAACUUUGGCCGGAUCUGCCACCAUGGACAAGAAGUA-<br>CAGCAUCGGCCUGGACAUCGGCACCAACAGCGUGGG<br>CUGGGCCGUGAUCACCGACGAGUACAAGGUGCCCAGCAAGAAGUUCAAG-<br>GUGCUGGGCAACACCGACCGGCACAGCAUCAAGAAGAACCUGAUC<br>GGCGCCCUGCUGUUCGACAGCGGCGAGACCGCCGAGGC-<br>CACCCGGCUGAAGCGGACCGCCCGGCGGCGGUACACCCGGCGGAAGAACCGGAUCU<br>GCUACCUGCAGGAGAUCUUCAGCAACGAGAUGGCCAAGGUGGACGACAGCUUCUUC-<br>CACCGGCUGGAGGAGAGCUUCCUGGUGGAGGAGGACAA<br>GAAGCACGAGCGGCACCCCAUCUUCGGCAACAUCGUGGACGAGGUGGCCUACCACGAGA-<br>AGUACCCCACCAUCUACCACCUGCGGAAGAAGCUG<br>GUGGACAGCACCGACAAGGCCGACCUGCGGCUGAUCUACCUGGCCCUGGCCCACAUGAU-<br>CAAGUUCCGGGGCCACUUCCUGAUCGAGGGCGACC<br>UGAACCCCGACAACAGCGACGUGGACAAGCUGUUCAUCCAGCUGGUGCAGACCUA-<br>CAACCAGCUGUUCGAGGAGAACCCCAUCAACGCCAGCGG<br>CGUGGACGCCAAGGCCAUCCUGAGCGCCCGGCUGAGCAAGAGCCGGCGGCUGGAGAAC-<br>CUGAUCGCCCAGCUGCCCGGCGAGAAGAAGAACGGC<br>CUGUUCGGCAACCUGAUCGCCCUGAGCCUGGGCCUGACCCCCAACUUCAAGAGCAAC-<br>UUCGACCUGGCCGAGGACGCCAAGCUGCAGCUGAGCA<br>AGGACACCUACGACGACGACCUGGACAACCUGCUGGCCCAGAUCGGCGACC-<br>AGUACGCCGACCUGUUCCUGGCCGCCAAGAACCUGAGCGACGC<br>CAUCCUGCUGAGCGACAUCCUGCGGGUGAACACCGAGAUCACCAAGGCCCCC-<br>CUGAGCGCCAGCAUGAUCAAGCGGUACGACGAGCACCACCAG<br>GACCUGACCCUGCUGAAGGCCCUGGUGCGGCAGCAGCUGCCCGAGAAGUACAAGGAGAUC-<br>UUCUUCGACCAGAGCAAGAACGGCUACGCCGGCU<br>ACAUCGACGGCGGCGCCAGCCAGGAGGAGUUCUACAAGUUCAUCAAGCCCAUCCUG-<br>GAGAAGAUGGACGGCACCGAGGAGCUGCUGGUGAAGCU<br>GAACCGGGAGGACCUGCUGCGGAAGCAGCGGACCUUCGACAACGGCAGCAUCCCC-<br>CACCAGAUCCACCUGGGCGAGCUGCACGCCAUCCUGCGG<br>CGGCAGGAGGACUUCUACCCCUUCCUGAAGGACAACCGGGAGAAGAUCGAGAAGAUC-<br>CUGACCUUCCGGAUCCCCUACUACGUGGGCCCCCUGG<br>CCCGGGGCAACAGCCGGUUCGCCUGGAUGACCCGGAAGAGCGAGGAGACCAUCACCCC-<br>CUGGAACUUCGAGGAGGUGGUGGACAAGGGCGCCAG<br>CGCCCAGAGCUUCAUCGAGCGGAUGACCAACUUCGACAAGAACCUGCCCAACGAGAAG-<br>GUGCUGCCCAAGCACAGCCUGCUGUACGAGUACUUC<br>ACCGUGUACAACGAGCUGACCAAGGUGAAGUACGUGACCGAGGGCAUGCGGAAGCCCGCC-<br>UUCCUGAGCGGCGAGCAGAAGAAGGCCAUCGUGG<br>ACCUGCUGUUCAAGACCAACCGGAAGGUGACCGUGAAGCAGCUGAAGGAGGACUACUU-<br>CAAGAAGAUCGAGUGCUUCGACAGCGUGGAGAUCAG<br>CGGCGUGGAGGACCGGUUCAACGCCAGCCUGGGCACCUACCACGACCUGCUGAAGAUCAU-<br>CAAGGACAAGGACUUCCUGGACAACGAGGAGAAC<br>GAGGACAUCCUGGAGGACAUCGUGCUGACCCUGACCCUGUUCGAGGACCGG-<br>GAGAUGAUCGAGGAGCGGCUGAAGACCUACGCCCACCUGUUCG<br>ACGACAAGGUGAUGAAGCAGCUGAAGCGGCGGCGGUA-<br>CACCGGCUGGGGCCGGCUGAGCCGGAAGCUGAUCAACGGCAUCCGGGACAAGCAGAG<br>CGGCAAGACCAUCCUGGACUUCCUGAAGAGCGACGGCUUCGCCAACCGGAACUU-<br>CAUGCAGCUGAUCCACGACGACAGCCUGACCUUCAAGGAG<br>GACAUCCAGAAGGCCCAGGUGAGCGGCCAGGGCGACAGCCUGCACGAGCACAUCGCCAAC-<br>CUGGCCGGCAGCCCCGCCAUCAAGAAGGGCAUCC<br>UGCAGACCGUGAAGGUGGUGGACGAGCUGGUGAAG-<br>GUGAUGGGCCGGCACAAGCCCGAGAACAUCGUGAUCGAGAUGGCCCGGGAGAACCAGAC<br>CACCCAGAAGGGCCAGAAGAACAGCCGGGAGCGGAUGAAGCGGAUCGAGGAGGGCAU-<br>CAAGGAGCUGGGCAGCCAGAUCCUGAAGGAGCACCCC<br>GUGGAGAACACCCAGCUGCAGAACGAGAAGCUGUACCUGUACUAC-<br>CUGCAGAACGGCCGGGACAUGUACGUGGACCAGGAGCUGGACAUCAACC<br>GGCUGAGCGACUACGACGUGGACCACAUCGUGCCCCAGAGCUUCCUGAAGGACGACAG-<br>CAUCGACAACAAGGUGCUGACCCGGAGCGACAAGAA<br>CCGGGGCAAGAGCGACAACGUGCCCAGCGAGGAGGUGGUGAAGAAGAUGAAGAACUA-<br>CUGGCGGCAGCUGCUGAACGCCAAGCUGAUCACCCAG<br>CGGAAGUUCGACAACCUGACCAAGGCCGAGCGGGGCGGC-<br>CUGAGCGAGCUGGACAAGGCCGGCUUCAUCAAGCGGCAGCUGGUGGAGACCCGGC<br>AGAUCACCAAGCACGUGGCCCAGAUCCUGGACAGCCGGAUGAACACCA-<br>AGUACGACGAGAACGACAAGCUGAUCCGGGAGGUGAAGGUGAUCAC<br>CCUGAAGAGCAAGCUGGUGAGCGACUUCCGGAAGGACUUCCAGUUCUACAAGGUGCGG-<br>GAGAUCAACAACUACCACCACGCCCACGACGCCUAC<br>CUGAACGCCGUGGUGGGCACCGCCCUGAUCAAGAAGUACCCCAAGCUG-<br>GAGAGCGAGUUCGUGUACGGCGACUACAAGGUGUACGACGUGCGGA | 178 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | AGAUGAUCGCCAAGAGCGAGCAGGAGAUCGGCAAGGCCACCGCCAAGUACUUCUUCUA-CAGCAACAUCAUGAACUUCUUCAAGACCGAGAUCAC<br>CCUGGCCAACGGCGAGAUCCGGAAGCGGCCCCUGAUCGAGACCAACGGCGA-GACCGGCGAGAUCGUGUGGGACAAGGGCCGGGACUUCGCCACC<br>GUGCGGAAGGUGCUGAGCAUGCCCCAGGUGAACAUCGUGAAGAAGACCGAGGUGCA-GACCGGCGGCUUCAGCAAGGAGAGCAUCCUGCCCAAGC<br>GGAACAGCGACAAGCUGAUCGCCCGGAAGAAGGACUGGGACCCCAAGAAGUACGGCGGC-UUCGACAGCCCCACCGUGGCCUACAGCGUGCUGGU<br>GGUGGCCAAGGUGGAGAAGGGCAAGAGCAAGAAGCUGAAGAGCGUGAAGGAGCUGCUGGG-CAUCACCAUCAUGGAGCGGAGCAGCUUCGAGAAG<br>AACCCCAUCGACUUCCUGGAGGCCAAGGGCUACAAGGAGGUGAAGAAGGACCUGAUCAU-CAAGCUGCCCAAGUACAGCCUGUUCGAGCUGGAGA<br>ACGGCCGGAAGCGGAUGCUGGCCAGCGCCGGCGAGCUGCAGAAGGGCAACGAGCUGGCC-CUGCCCAGCAAGUACGUGAACUUCCUGUACCUGGC<br>CAGCCACUACGAGAAGCUGAAGGGCAGCCCCGAGGACAACGAGCAGAAGCAGCU-GUUCGUGGAGCAGCACAAGCACUACCUGGACGAGAUCAUC<br>GAGCAGAUCAGCGAGUUCAGCAAGCGGGUGAUCCUGGCCGACGCCAACCUGGACAAG-GUGCUGAGCGCCUACAACAAGCACCGGGACAAGCCCA<br>UCCGGGAGCAGGCCGAGAACAUCAUCCACCUGUUCACCCUGACCAAC-CUGGGCGCCCCCGCCGCCUUCAAGUACUUCGACACCACCAUCGACCG<br>GAAGCGGUACACCAGCACCAAGGAGGUGCUGGACGCCACCCUGAUCCACCAGAGCAU-CACCGGCCUGUACGAGACCCGGAUCGACCUGAGCCAG<br>CUGGGCGGCGACGGCGGCGGCAGCCCCAAGAAGAAGCGGAAGGUGUGACUAGCACCAGC-CUCAAGAACACCCGAAUGGAGUCUCUAAGCUACAU<br>AAUACCAACUUACACUUUACAAAAUGUUGUCCCCAAAAUGUAGCCAUUCGUAUCUGCUC-CUAAUAAAAAGAAAGUUUCUUCACAUUCUCUCGA<br>GAAAAAAAAAAAAAAAAAAAAAAAAAAAAAAAAAAAAAAAAAAAAAAAAAAAAAAAAAAAAAAAAAAAAAAAAAAAAAAAAAAAAAAAUCUAG | |
| mRNA transcript with ORF encoding Cas9 with HiBiT tag, HSD 5' UTR and human ALB 3' UTR | GGGTCCCGCAGTCGGCGTCCAGCGGCTCTGCTTGTTCGTGTGTGTGTCGTTGCAGGCCTT-ATTCGGATCCGCCACCATGGACAAGAAGTACAGC<br>ATCGGACTGGACATCGGAACAAACAGCGTCGGATGGGCAGTCATCACAGACGAATA-CAAGGTCCCGAGCAAGAAGTTCAAGGTCCTGGGAAACA<br>CAGACAGACACAGCATCAAGAAGAACCTGATCGGAGCACTGCTGTTCGACAGCG-GAGAAACAGCAGAAGCAACAAGACTGAAGAGAACAGCAAG<br>AAGAAGATACAAGAAGAAAGAACAGAATCTGCTACCTGCAG-GAAATCTTCAGCAACGAAATGGCAAAGGTCGACGACAGCTTCTTCCACAGA<br>CTGGAAGAAAGCTTCCTGGTCGAAGAAGACAAGAAGCACGAAAGACACCCGATCTTCG-GAAACATCGTCGACGAAGTCGCATACCACGAAAAGT<br>ACCCGACAATCTACCACCTGAGAAAGAAGCTGGTCGACAGCACAGACAAGGCAGACCTGA-GACTGATCTACCTGGCACTGGCACACATGATCAA<br>GTTCAGAGGACACTTCCTGATCGAAGGAGACCT-GAACCCGGACAACAGCGACGTCGACAAGCTGTTCATCCAGCTGGTCCAGACATACAACCAG<br>CTGTTCGAAGAAAACCCGATCAACGCAAGCGGAGTCGACGCAAAGGCAATCCT-GAGCGCAAGACTGAGCAAGAGCAGAAGACTGGAAAACCTGA<br>TCGCACAGCTGCCGGGAGAAAAGAAGAACGGACTGTTCGGAAACCTGATCGCACT-GAGCCTGGGACTGACACCGAACTTCAAGAGCAACTTCGA<br>CCTGGCAGAAGACGCAAAGCTGCAGCTGAGCAAGGACACAT-ACGACGACGACCTGGACAACCTGCTGGCACAGATCGGAGACCAGTACGCAGAC<br>CTGTTCCTGGCAGCAAAGAACCTGAGCGACGCAATCCTGCTGAGCGACATCCTGAGAGT-CAACACAGAAATCACAAAGGCACCGCTGAGCGCAA<br>GCATGATCAAGAGATACGACGAACACCACCAGGACCTGACACTGCTGAAGGCACTGGTCA-GACAGCAGCTGCCGGAAAAGTACAAGGAAATCTTT<br>CTTCGACCAGAGCAAGAACGGATACGCAGGATACATCGACGGAGGAGCAAGCCAG-GAAGAATTCTACAAGTTCATCAAGCCGATCCTGGAAAAG<br>ATGGACGGAACAGAAGAACTGCTGGTCAAGCTGAACAGAGAAGACCTGCT-GAGAAAGCAGAGAACATTCGACAACGGAAGCATCCCGCACCAGA<br>TCCACCTGGGAGAACTGCACGCAATCCTGAGAAGACAGGAAGACTTCTACCCGTTCCT-GAAGGACAACAGAGAAAAGATCGAAAAGATCCTGAC<br>ATTCAGAATCCCGTACTACGTCGGACCGCTGGCAAGAGGAAACAGAGATTCGCATG-GATGACAAGAAAGAGCGAAGAAACAATCACACCGTGG<br>AACTTCGAAGAAGTCGTCGACAAGGGAGCAAGCGCACAGAGCTT-CATCGAAAGAATGACAAACTTCGACAAGAACCTGCCGAACGAAAGGTCC<br>TGCCGAAGCACAGCCTGCTGTACAATACTTCACAGTCTACAACGAACTGACAAAGGT-CAAGTACGTCACAGAAGGAATGAGAAAGCCGGCATT<br>CCTGAGCGGAGAACAGAAGAAGGCAATCGTCGACCTGCTGTTCAAGACAAACAGAAAGGT-CACAGTCAAGCAGCTGAAGGAAGACTACTTCAAG<br>AAGATCGAATGCTTCGACAGCGTCGAAATCAGCGGAGTCGAAGACAGATT-CAACGCAAGCCTGGGAACATACCACGACCTGCTGAAGATCATCA<br>AGGACAAGGACTTCCTGGACAACGAAGAAAACGAAGACATCCTGGAAGA-CATCGTCCTGACACTGACACTGTTCGAAGACAGAGAAATGATCGA<br>AGAAAGACTGAAGACATACGCACACCTGTTCGACGCAAGGTCATGAAGCAGCT-GAAGAGAAGAAGATACACAGGATGGGAAGACTGAGCAGA<br>AAGCTGATCAACGGAATCAGAGACAAGCAGAGCGGAAAGACAATCCTGGACTTCCT-GAAGAGCGACGGATTCGCAAACAGAAACTTCATGCAGC | 179 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | TGATCCACGACGACAGCCTGACATTCAAGGAAGA-CATCCAGAAGGCACAGGTCAGCGGACAGGGAGACAGCCTGCACGAACACATCGCAAACCT GGCAGGAAGCCCGGCAATCAAGAAGGGAATCCTGCAGACAGT-CAAGGTCGTCGACGAACTGGTCAAGGTCATGGGAAGACACAAGCCGGAAAAC ATCGTCATCGAAATGGCAAGAGAAAACCA-GACAACACAGAAGGGACAGAAGAACAGCAGAGAAAGAATGAAGAGAATCGAAGAAGGAATCAAGG AACTGGGAAGCCAGATCCT-GAAGGAACACCCGGTCGAAAACACACAGCTGCAGAACGAAAAGCTGTACCTGTACTACCTGCAGAACGGAAGAGA CATGTACGTCGACCAGGAACTGGACATCAACAGACTGAGCGACTACGACGTCGACCA-CATCGTCCCGCAGAGCTTCCTGAAGGACGACAGCATC GACAACAAGGTCCTGACAAGAAGCGACAAGAACAGAG-GAAAGAGCGACAACGTCCCGAGCGAAGAAGTCGTCAAGAAGATGAAGAACTACTGGA GACAGCTGCTGAACGCAAAGCTGAT-CACACAGAGAAAGTTCGACAACCTGACAAAGGCAGAGAGAGGAGGACTGAGCGAACTGGACAAGGCAGG ATTCATCAAGAGACAGCTGGTCGAAACAAGACAGATCACAAAGCACGTCGCACA-GATCCTGGACAGCAGAATGAACACAAAGTACGACGAAAAC GACAAGCTGATCAGAGAAGTCAAGGTCATCACACT-GAAGAGCAAGCTGGTCAGCGACTTCAGAAAGGACTTCCAGTTCTACAAGGTCAGAGAAA TCAACAACTACCACCACGCACACGACGCATACCTGAACGCAGTCGTCGGAACAGCACT-GATCAAGAAGTACCCGAAGCTGGAAAGCGAATTCGT CTACGGAGACTACAAGGTCTACGACGTCAGAAAGATGATCGCAAAGAGCGAACAG-GAAATCGGAAAGGCAACAGCAAAGTACTTCTTCTACAGC AACATCATGAACTTCTTCAAGACAGAAATCACACTGGCAAACGGAGAAATCAGAAAGA-GACCGCTGATCGAAACAAACGGAGAAACAGGAGAAA TCGTCTGGGACAAGGGAAGAGACTTCGCAACAGTCAGAAAGGTCCTGAG-CATGCCGCAGGTCAACATCGTCAAGAAGACAGAAGTCCAGACAGG AGGATTCAGCAAGGAAAGCATCCTGCCGAAGAGAAACAGCGACAAGCT-GATCGCAAGAAAGAAGGACTGGGACCCGAAGAAGTACGGAGGATTC GACAGCCCGACAGTCGCATACAGCGTCCTGGTCGTCGCAAAGGTCGAAAGG-GAAAGAGCAAGAAGCTGAAGAGCGTCAAGGAACTGCTGGGAA TCACAATCATGGAAAGAAGCAGCTTCGAAAAGAACCCGATCGACTTCCTGGAAGCAAAGG-GATACAAGGAAGTCAAGAAGGACCTGATCATCAA GCTGCCGAAGTACAGCCTGTTCGAACTGGAAAACG-GAAGAAAGAGAATGCTGGCAAGCGCAGGAGAACTGCAGAAGGGAAACGAACTGGCACTG CCGAGCAAGTACGTCAACTTCCTGTACCTGGCAAGCCACTACGAAAAGCTGAAGG-GAAGCCCGGAAGACAACGAACAGAAGCAGCTGTTCGTCG AACAGCACAAGCACTACCTGGACGAAATCATCGAACAGATCAGCGAAT-TCAGCAAGAGAGTCATCCTGGCAGACGCAAACCTGGACAAGGTCCT GAGCGCATACAACAAGCACAGAGACAAGCCGATCAGAGAACAGGCAGAAAACATCATC-CACCTGTTCACACTGACAAACCTGGGAGCACCGGCA GCATTCAAGTACTTCGACACAACAATCGACAGAAAGAGATA-CACAAGCACAAAGGAAGTCCTGGACGCAACACTGATCCACCAGAGCATCACAG GACTGTACGAAACAAGAATCGACCTGAGCCAGCTGGGAGGAGACGGAGGAG-GAAGCCCGAAGAAGAAGAAAGGTCAGCGAAAGCGCAACACC GGAAAGCGTCAGCGGATGGAGACTGTTCAAGAAGATCAGCTAGCTAGCCATCACATT-TAAAAGCATCTCAGCCTACCATGAGAATAAGAGAAAG AAAATGAAGATCAATAGCTTATTCATCTCTTTTTCTTTTTCGTTGGTGTAAAGC-CAACACCCTGTCTAAAAAACATAAATTTCTTTAATCATTT TGCCTCTTTTCTCTGTGCTTCAATTAATAAAAAATG-GAAAGAACCTCGAGAAAAAAAAAAAAAAAAAAAAAAAAAAAAAAAAAAAAAA AAAAAAAAAAAAAAAAAAAAAAAAAAAAAAAAAAAAAAAAAAATCTAG | |
| mRNA transcript with ORF encoding Cas9 with HiBiT tag, CMV-1 | GGGCAGATCGCCTGGAGACGCCATCCACGCTGTTTTGACCTCCATCGCCAC-CATGGACAAGAAGTACAGCATCGGACTGGACATCGGAACAAAC AGCGTCGGATGGGCAGTCATCACAGACGAATACAAGGTCCCGAGCAAGAAGTT-CAAGGTCCTGGGAAACACAGACAGACACAGCATCAAGAAGA ACCTGATCGGAGCACTGCTGTTCGACAGCGGAGAAACAGCAGAAGCAACAAGACT-GAAGAGAACAGCCAAGAAGAAGATACACAAGAAGAAAGAA CAGAATCTGCTACCTGCAG-GAAATCTTCAGCAACGAAATGGCAAAGGTCGACGACAGCTTCTTCCACAGACTGGAAGAAAGCTTCCTGGTCGAA GAAGACAAGAAGCACGAAAGACACCCGATCTTCGGAAACATCGTCGACGAAGTCGCATAC-CACGAAAAGTACCCGACAATCTACCACCTGAGAA AGAAGCTGGTCGACAGCACAGACAAGGCAGACCTGAGACTGATC-TACCTGGCACTGGCACACATGATCAAGTTCAGAGGACACTTCCTGATCGA AGGAGACCTGAACCCGGACAACAGCGACGTCGACAAGCTGTTCATCCAGCTGGTCCAGA-CATACAACCAGCTGTTCGAAGAAAACCCGATCAAC GCAAGCGGAGTCGACGCAAAGGCAATCCTGAGCGCAAGACTGAGCAAGAGCAGAAGACTG-GAAAACCTGATCGCACAGCTGCCGGGAGAAAAGA AGAACGGACTGTTCGGAAACCTGATCGCACTGAGCCTGGGACTGACACCGAACTT-CAAGAGCAACTTCGACCTGGCAGAAGACGCAAAGCTGCA GCTGAGCAAGGACACATACGACGACGACCTGGACAACCTGCTGGCACAGATCGGA-GACCAGTACGCAGACCTGTTCCTGGCAGCAAAGAACCTG AGCGACGCAATCCTGCTGAGCGACATCCTGAGAGTCAACACAGAAAT-CACAAAGGCACCGCTGAGCGCAAGCATGATCAAGAGATACGACGAAC ACCACCAGGACCTGACACTGCTGAAGGCACTGGTCAGACAGCAGCTGCCGGAAAAGTA-CAAGGAAATCTTCTTCGACCAGAGCAAGAACGGATA | 180 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| 5' UTR and human ALB 3' UTR | CGCAGGATACATCGACGGAGGAGCAAGCCAGGAAGAATTCTACAAGTTCATCAAGCC-GATCCTGGAAAAGATGGACGGAACAGAAGAACTGCTG GTCAAGCTGAACAGAGAAGACCTGCTGAGAAAGCAGAGAACATTCGACAACG-GAAGCATCCCGCACCAGATCCACCTGGGAGAACTGCACGCAA TCCTGAGAAGCAGGAAGACTTCTACCCGTTCCTGAAGGACAACAGAGAAAA-GATCGAAAAGATCCTGACATTCAGAATCCCGTACTACGTCGG ACCGCTGGCAAGAGGAAACAGCAGATTCGCATGGATGACAAGAAAGAGCGAAGAAACAAT-CACACCGTGGAACTTCGAAGAAGTCGTCGACAAG GGAGCAAGCGCACAGAGCTT-CATCGAAAGAATGACAAACTTCGACAAGAACCTGCCGAACGAAAAGGTCCTGCCGAAGCACAGCCTGCTGTACG AATACTTCACAGTCTACAACGAACTGACAAAGGTCAAGTACGTCACAGAAGGAAT-GAGAAAGCCGGCATTCCTGAGCGGAGAACAGAAGAAGGC AATCGTCGACCTGCTGTTCAAGACAAACAGAAAGGTCACAGTCAAGCAGCTGAAGGAA-GACTACTTCAAGAAGATCGAATGCTTCGACAGCGTC GAAATCAGCGGAGTCGAAGACAGATTCAACGCAAGCCTGGGAACATACCACGACCTGCT-GAAGATCATCAAGGACAAGGACTTCCTGGACAACG AAGAAAACGAAGACATCCTGGAAGACATCGTCCTGACACTGACACTGTTCGAA-GACAGAGAAATGATCGAAGAAAGACTGAAGACATACGCACA CCTGTTCGACGACAAGGTCATGAAGCAGCTGAAGAGAAGAAGATACACAGGATGGGAA-GACTGAGCAGAAAGCTGATCAACGAATCAGAGAC AAGCAGAGCGGAAAGACAATCCTGGACTTCCTGAAGAGCGACGGAT-TCGCAAACAGAACTTCATGCAGCTGATCCACGACGACAGCCTGACAT TCAAGGAAGACATCCAGAAGGCACAGGTCAGCGGACAGGGAGACAGCCTGCACGAACA-CATCGCAAACCTGGCAGGAAGCCCGGCAATCAAGAA GGGAATCCTGCAGACAGTCAAGGTCGTCGACGAACTGGTCAAGGTCATGGGAA-GACACAAGCCGGAAAACATCGTCATCGAAATGGCAAGAGAA AACCAGACAACACAGAAGGGACAGAAGAACAGCAGAGAAAGAAT-GAAGAGAATCGAAGAAGGAATCAAGGAACTGGGAAGCCAGATCCTGAAGG AACACCCGGTCGAAAACACACAGCTGCAGAACGAAAAGCTGTACCTGTAC-TACCTGCAGAACGGAAGAGACATGTACGTCGACCAGGAACTGGA CATCAACAGACTGAGCGACTACGACGTCGACCACATCGTCCCGCAGAGCTTCCT-GAAGGACGACAGCATCGACAACAAGGTCCTGACAAGAAGC GACAAGAACAGAGGAAAGAGCGACAACGTCCCGAGCGAAGAAGTCGTCAAGAAGAT-GAAGAACTACTGGAGACAGCTGCTGAACGCAAAGCTGA TCACACAGAGAAAGTTCGACAACCTGACAAAGGCAGAGAGAGGAGGACT-GAGCGAACTGGACAAGGCAGGATTCATCAAGAGACAGCTGGTCGA AACAAGACAGATCACAAAGCACGTCGCACAGATCCTGGACAGCAGAAT-GAACACAAAGTACGACGAAAACGACAAGCTGATCAGAGAAGTCAAG GTCATCACACTGAAGAGCAAGCTGGTCAGCGACTTCAGAAAGGACTTCCAGTTCTA-CAAGGTCAGAGAAATCAACAACTACCACCACGCACACG ACGCATACCTGAACGCAGTCGTCGGAACAGCACTGATCAAGAAGTACCCGAAGCTG-GAAAGCGAATTCGTCTACGAGACTACAAGGTCTACGA CGTCAGAAAGATGATCGCAAAGAGCGAACAGGAAATCG-GAAAGGCAACAGCAAAGTACTTCTTCTACAGCAACATCATGAACTTCTTCAAGACA GAAATCACACTGGCAAACGGAGAAATCAGAAAGAGACCGCTGATCGAAACAAACG-GAGAAACAGGAGAAATCGTCTGGGACAAGGGAAGAGACT TCGCAACAGTCAGAAAGGTCCTGAGCATGCCGCAGGTCAACATCGTCAAGAA-GACAGAAGTCCAGACAGGAGGATTCAGCAAGGAAAGCATCCT GCCGAAGAGAAACAGCGACAAGCT-GATCGCAAGAAAGAAGGACTGGGACCCGAAGAAGTACGGAGGATTCGACAGCCCGACAGTCGCATACAGC GTCCTGGTCGTCGCAAAGGTCGAAAAGGGAAAGAGCAAGAAGCTGAAGAGCGT-CAAGGAACTGCTGGGAATCACAATCATGGAAAGAAGCAGCT TCGAAAAGAACCCGATCGACTTCCTGGAAGCAAAGGGATACAAGGAAGT-CAAGAAGGACCTGATCATCAAGCTGCCGAAGTACAGCCTGTTCGA ACTGGAAAACGGAAGAAAGAGAATGCTGGCAAGCGCAGGAGAACTGCAGAAGG-GAAACGAACTGGCACTGCCGAGCAAGTACGTCAACTTCCTG TACCTGGCAAGCCACTACGAAAAGCTGAAGGGAAGCCCGGAA-GACAACGAACAGAAGCAGCTGTTCGTCGAACAGCACAAGCACTACCTGGACG AAATCATCGAACAGATCAGCGAATTCAGCAAGAGAGTCATCCTGGCA-GACGCAAACCTGGACAAGGTCCTGAGCGCATACAACAAGCACAGAGA CAAGCCGATCAGAGAACAGGCAGAAAACATCATCCACCTGTTCACACTGACAAACCTGG-GAGCACCGGCAGCATTCAAGTACTTCGACACAACA ATCGACAGAAAGAGATACACAAGCACAAAGGAAGTCCTGGACGCAACACACTGATC-CACCAGAGCATCCAGGACTGTACGAAACAAGAATCGACC TGAGCCAGCTGGGAGGAGACGAGGAG-GAAGCCCGAAGAAGAAGAGAAAGGTCAGCGAAAGCGCAACACCGGAAAGCGTCAGCGGATGGAGACT GTTCAAGAAGATCAGCTAGCTAGCCATCACATTTAAAAGCATCTCAGCCTACCAT-GAGAATAAGAGAAAGAAAATGAAGATCAATAGCTTATTC ATCTCTTTTTCTTTTTCGTTGGTGTAAAGCCAACACCCTGTCTAAAAACATAAAT-TTCTTTAATCATTTTGCCTCTTTTCTCTGTGCTTCAAT TAATAAAAATG-GAAAGAACCTCGAGAAAAAAAAAAAAAAAAAAAAAAAAAAAAAAAAAAAAAAAAAAAAAAAAAAAAAA | |
| mRNA | GGGAGAAGACACCGGGACCGATCCAGCCTCCGCGGCCGGGAACGGCGCCAC-CATGGACAAGAAGTACAGCATCGGACTGGACATCGGAACAAAC | 181 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| transcript with ORF encoding Cas9 with HiBiT tag, CMV-2 5' UTR and human ALB 3' UTR | AGCGTCGGATGGGCAGTCATCACAGACGAATACAAGGTCCCGAGCAAGAAGTT-CAAGGTCCTGGGAAACACAGACAGACACAGCATCAAGAAGA ACCTGATCGGAGCACTGCTGTTCGACAGCGGAGAAACAGCAGAAGCAACAAGACT-GAAGAGAACAGCAAGAAGAAGATACACAAGAAGAAAGAA CAGAATCTGCTACCTGCAG-GAAATCTTCAGCAACGAAATGGCAAAGGTCGACGACAGCTTCTTCCACAGACTGGAAGAAAGCTTCCTGGTCGAA GAAGACAAGAAGCACGAAAGACACCCGATCTTCGGAAACATCGTCGACGAAGTCGCATAC-CACGAAAAGTACCCGACAATCTACCACCTGAGAA AGAAGCTGGTCGACAGCACAGACAAGGCAGACCTGAGACTGATC-TACCTGGCACTGGCACACATGATCAAGTTCAGAGGACACTTCCTGATCGA AGGAGACCTGAACCCGGACAACAGCGACGTCGACAAGCTGTTCATCCAGCTGGTCCAGA-CATACAACCAGCTGTTCGAAGAAAACCCGATCAAC GCAAGCGGAGTCGACGCAAAGGCAATCCTGAGCGCAAGACTGAGCAAGAGCAGAAGACTG-GAAAACCTGATCGCACAGCTGCCGGGAGAAAAGA AGAACGGACTGTTCGGAAACCTGATCGCACTGAGCCTGGGACTGACACCGAACTT-CAAGAGCAACTTCGACCTGGCAGAAGACGCAAAGCTGCA GCTGAGCAAGGACACATACGACGACGACCTGGACAACCTGCTGGCACAGATCGGA-GACCAGTACGCAGACCTGTTCCTGGCAGCAAAGAACCTG AGCGACGCAATCCTGCTGAGCGACATCCTGAGAGTCAACACAGAAAT-CACAAAGGCACCGCTGAGCGCAAGCATGATCAAGAGATACGACGAAC ACCACCAGGACCTGACACTGCTGAAGGCACTGGTCAGACAGCAGCTGCCGGAAAAGTA-CAAGGAAATCTTCTTCGACCAGAGCAAGAACGGATA CGCAGGATACATCGACGGAGGAGCAAGCCAGGAAGAATTCTACAAGTTCATCAAGCC-GATCCTGGAAAAGATGGACGGAACAGAAGAACTGCTG GTCAAGCTGAACAGAGAAGACCTGCTGAGAAAGCAGAGAACATTCGACAACG-GAAGCATCCCGCACCAGATCCACCTGGGAGAACTGCACGCAA TCCTGAGAAGACAGGAAGACTTCTACCCGTTCCTGAAGGACAACAGAGAAAA-GATCGAAAAGATCCTGACATTCAGAATCCCGTACTACGTCGG ACCGCTGGCAAGAGGAAACAGCAGATTCGCATGGATGACAAGAAAGAGCGAAGAACAAT-CACACCGTGGAACTTCGAAGAAGTCGTCGACAAG GGAGCAAGCGCACAGAGCTT-CATCGAAAGAATGACAAACTTCGACAAGAACCTGCCGAACGAAAAGGTCCTGCCGAAGCACAGCCTGCTGTACG AATACTTCACAGTCTACAACGAACTGACAAAGGTCAAGTACGTCACAGAAGGAAT-GAGAAAGCCGGCATTCCTGAGCGGAGAACAGAAGAAGGC AATCGTCGACCTGCTGTTCAAGACAAACAGAAAGGTCACAGTCAAGCAGCTGAAGGAA-GACTACTTCAAGAAGATCGAATGCTTCGACAGCGTC GAAATCAGCGGAGTCGAAGACAGATTCAACGCAAGCCTGGGAACATACCACGACCTGCT-GAAGATCATCAAGGACAAGGACTTCCTGGACAACG AAGAAAACGAAGACATCCTGGAAGACATCGTCCTGACACTGACACTGTTCGAA-GACAGAGAAATGATCGAAGAAAAGACTGAAGACATACGCACA CCTGTTCGACGACAAGGTCATGAAGCAGCTGAAGAGAAGAAGATACACAGGATGGGAA-GACTGAGCAGAAAGCTGATCAACGGAATCAGAGAC AAGCAGAGCGGAAAGACAATCCTGGACTTCCTGAAGAGCGACGGAT-TCGCAAACAGAAACTTCATGCAGCTGATCCACGACGACAGCCTGACAT TCAAGGAAGACATCCAGAAGGCACAGGTCAGCGGACAGGGAGACAGCCTGCACGAACA-CATCGCAAACCTGGCAGGAAGCCCGGCAATCAAGAA GGGAATCCTGCAGACAGTCAAGGTCGTCGACGAACTGGTCAAGGTCATGGGAA-GACACAAGCCGGAAAACATCGTCATCGAAATGGCAAGAGAA AACCAGACAACACAGAGGGACAGAAGAACAGCAGAGAAAGAAT-GAAGAGAATCGAAGAAGGAATCAAGGAACTGGGAAGCCAGATCCTGAAGG AACACCCGGTCGAAAACACACAGCTGCAGAACGAAAAGCTGTACCTGTAC-TACCTGCAGAACGGAAGAGACATGTACGTCGACCAGGAACTGGA CATCAACAGACTGAGCGACTACGACGTCGACCACATCGTCCCGCAGAGCTTCCT-GAAGGACGACAGCATCGACAACAAGGTCCTGACAAGAAGC GACAAGAACAGAGGAAAGAGCGACAACGTCCCGAGCGAAGAAGTCGTCAAGAAGAT-GAAGAACTACTGGAGACAGCTGCTGAACGCAAAGCTGA TCACACAGAGAAAGTTCGACAACCTGACAAAGGCAGAGAGAGGAGGACT-GAGCGAACTGGACAAGGCAGGATTCATCAAGAGACAGCTGGTCGA AACAAGACAGATCACAAAGCACGTCGCACAGATCCTGGACAGCAGAAT-GAACACAAAGTACGACGAAAACGACAAGCTGATCAGAGAAGTCAAG GTCATCACACTGAAGAGCAAGCTGGTCAGCGACTTCAGAAAGGACTTCCAGTTCTA-CAAGGTCAGAGAAATCAACAACTACCACCACGCACACG ACGCATACCTGAACGCAGTCGTCGGAACAGCACTGATCAAGAAGTACCCGAAGCTG-GAAAGCGAATTCGTCTACGGAGACTACAAGGTCTACGA CGTCAGAAAGATGATCGCAAAGAGCGAACAGGAAATCG-GAAAGGCAACAGCAAAGTACTTCTTCTACAGCAACATCATGAACTTCTTCAAGACA GAAATCACACTGGCAAACGGAGAAATCAGAAAGAGACCGCTGATCGAAACAAACG-GAGAAACAGGAGAAATCGTCTGGGACAAGGGAAGAGACT TCGCAACAGTCAGAAAGGTCCTGAGCATGCCGCAGGTCAACATCGTCAAGAA-GACAGAAGTCCAGACAGGAGGATTCAGCAAGGAAAGCATCCT GCCGAAGAGAAACAGCGACAAGCT-GATCGCAAGAAAGAAGGACTGGGACCCGAAGAAGTACGGAGGATTCGACAGCCCGACAGTCGCATACAGC GTCCTGGTCGTCGCAAAGGTCGAAAAGGGAAAGAGCAAGAAGCTGAAGAGCGT-CAAGGAACTGCTGGGAATCACAATCATGGAAAGCAGCT TCGAAAAGAACCCGATCGACTTCCTGGAAGCAAAGGGATACAAGGAAGT-CAAGAAGGACCTGATCATCAAGCTGCCGAAGTACAGCCTGTTCGA | |

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
|  | ACTGGAAAACGGAAGAAAGAGAATGCTGGCAAGCGCAGGAGAACTGCAGAAGG-GAAACGAACTGGCACTGCCGAGCAAGTACGTCAACTTCCTG TACCTGGCAAGCCACTACGAAAAGCTGAAGGGAAGCCCGGAA-GACAACGAACAGAAGCAGCTGTTCGTCGAACAGCACAAGCACTACCTGGACG AAATCATCGAACAGATCAGCGAATTCAGCAAGAGAGTCATCCTGGCA-GACGCAAACCTGGACAAGGTCCTGAGCGCATACAACAAGCACAGAGA CAAGCCGATCAGAGAACAGGCAGAAAACATCATCCACCTGTTCACACTGACAAACCTGG-GAGCACCGGCAGCATTCAAGTACTTCGACACAACA ATCGACAGAAAGAGATACACAAGCACAAAGGAAGTCCTGGACGCAACACTGATC-CACCAGAGCATCACAGGACTGTACGAAACAAGAATCGACC TGAGCCAGCTGGGAGGAGACGGAGGAG-GAAGCCCGAAGAAGAAGAGAAAGGTCAGCGAAAGCGCAACACCGGAAAGCGTCAGCGGATGGAGACT GTTCAAGAAGATCAGCTAGCTAGCCATCACATTTAAAAGCATCTCAGCCTACCAT-GAGAATAAGAGAAAGAAAATGAAGATCAATAGCTTATTC ATCTCTTTTTCTTTTTCGTTGGTGTAAAGCCAACACCCTGTCTAAAAAACATAAAT-TTCTTTAATCATTTTGCCTCTTTTCTCTGTGCTTCAAT TAATAAAAAATG-GAAAGAACCTCGAGAAAAAAAAAAAAAAAAAAAAAAAAAAAAAAAAAAAAAAAAAAAAAAAAAAAAAAAAA |  |
| mRNA transcript with ORF encoding Cas9 with HiBiT tag, CMV-3 5' UTR and human ALB 3' UTR | GGGTGCATTGGAACGCGGATTCCCCGTGCCAAGAGTGACTCACCGCGCCAC-CATGGACAAGAAGTACAGCATCGGACTGGACATCGGAACAGC AGCGTCGGATGGGCAGTCATCACAGACGAATACAAGGTCCCGAGCAAGAAGTT-CAAGGTCCTGGGAAACACAGACAGACACAGCATCAAGAAGA ACCTGATCGGAGCACTGCTGTTCGACAGCGGAGAAACAGCAGAAGCAACAAGACT-GAAGAGAACAGCAAGAAGAAGATACACAAGAAGAAAGAA CAGAATCTGCTACCTGCAG-GAAATCTTCAGCAACGAAATGGCAAAGGTCGACGACAGCTTCTTCCACAGACTGGAAGAAAGCTTCCTGGTCGAA GAAGACAAGAAGCACGAAAGACACCCGATCTTCGGAAACATCGTCGACGAAGTCGCATAC-CACGAAAAGTACCCGACAATCTACCACCTGAGAA AGAAGCTGGTCGACAGCACAGACAAGGCAGACCTGAGACTGATC-TACCTGGCACTGGCACACATGATCAAGTTCAGAGGACACTTCCTGATCGA AGGAGACCTGAACCCGGACAACAGCGACGTCGACAAGCTGTTCATCCAGCTGGTCCAGA-CATACAACCAGCTGTTCGAAGAAAACCCGATCAAC GCAAGCGGAGTCGACGCAAAGGCAATCCTGAGCGCAAGACTGAGCAAGAGCAGAAGACTG-GAAAACCTGATCGCACAGCTGCCGGGAGAAAGA AGAACGGACTGTTCGGAAACCTGATCGCACTGAGCCTGGGACTGACACCGAACTT-CAAGAGCAACTTCGACCTGGCAGAAGACGCAAAGCTGCA GCTGAGCAAGGACACATACGACGACGACCTGGACAACCTGCTGGCACAGATCGGA-GACCAGTACGCAGACCTGTTCCTGGCAGCAAAGAACCTG AGCGACGCAATCCTGCTGAGCGACATCCTGAGAGTCAACACAGAAAT-CACAAAGGCACCGCTGAGCGCAAGCATGATCAAGAGATACGACGAAC ACCACCAGGACCTGACACTGCTGAAGGCACTGGTCAGACAGCAGCTGCCGGAAAAGTA-CAAGGAAATCTTCTTCGACCAGAGCAAGAACGGATA CGCAGGATACATCGACGGAGGAGCAAGCCAGGAAGAATTCTACAAGTTCATCAAGCC-GATCCTGGAAAAGATGGACGGAACAGAAGAACTGCTG GTCAAGCTGAACAGAGAAGACCTGCTGAGAAAGCAGAGAACATTCGACAACG-GAAGCATCCCGCACCAGATCCACCTGGGAGAACTGCACGCAA TCCTGAGAAGACAGGAAGACTTCTACCCGTTCCTGAAGGACAACAGAGAAAA-GATCGAAAAGATCCTGACATTCAGAATCCCGTACTACGTCGG ACCGCTGGCAAGAGGAAACAGCAGATTCGCATGGATGACAAGAAAGCGAAGAAACAAT-CACACCGTGGAACTTCGAAGAAGTCGTCGACAAG GGAGCAAGCGCACAGAGCTT-CATCGAAAGAATGACAAACTTCGACAAGAACCTGCCGAACGAAAAGGTCCTGCCGAAGCACAGCCTGCTGTACG AATACTTCACAGTCTACAACGAACTGACAAAGGTCAAGTACGTCACAGAAGGAAT-GAGAAAGCCGGCATTCCTGAGCGGAGAACAGAAGAAGGC AATCGTCGACCTGCTGTTCAAGACAAACAGAAAGGTCACAGTCAAGCAGCTGAAGGAA-GACTACTTCAAGAAGATCGAATGCTTCGACAGCGTC GAAATCAGCGGAGTCGAAGACAGATTCAACGCAAGCCTGGGAACATACCACGACCTGCT-GAAGATCATCAAGGACAAGGACTTCCTGGACAACG AAGAAAACGAAGACATCCTGGAAGACATCGTCCTGACACTGACACTGTTCGAA-GACAGAGAAATGATCGAAAAGACTGAAGCATACGCACA CCTGTTCGACGACAAGGTCATGAAGCAGCTGAAGAGAAGAAGATACACAGGATGGGGAA-GACTGAGCAGAAAGCTGATCAACGGAATCAGAGAC AAGCAGAGCGGAAAGACAATCCTGGACTTCCTGAAGAGCGACGGAT-TCGCAAACAGAAACTTCATGCAGCTGATCCACGACGACAGCCTGACAT TCAAGGAAGACATCCAGAAGGCACAGGTCAGCGGACAGGGAGACAGCCTGCACGAACA-CATCGCAAACCTGGCAGGAAGCCCGGCAATCAAGAA GGGAATCCTGCAGACAGTCAAGGTCGTCGACGAACTGGTCAAGGTCATGGGAA-GACACAAGCCGGAAAACATCGTCATCGAAATGGCAAGAGAA AACCAGACAACACAGAGGGACAGAAGAACAGCAGAGAAAGAAT-GAAGAGAATCGAAGAAGGAATCAAGGAACTGGGAAGCCAGATCCTGAAGG AACACCCGGTCGAAAACACACAGCTGCAGAACGAAAAGCTGTACCTGTAC-TACCTGCAGAACGGAAGAGACATGTACGTCGACCAGGAACTGGA CATCAACAGACTGAGCGACTACGACGTCGACCACATCGTCCCGCAGAGCTTCCT-GAAGGACGACAGCATCGACAACAAGGTCCTGACAAGAAGC | 182 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | GACAAGAACAGAGGAAAGAGCGACAACGTCCCGAGCGAAGAAGTCGTCAAGAAGAT-<br>GAAGAACTACTGGAGACAGCTGCTGAACGCAAAGCTGA<br>TCACACAGAGAAAGTTCGACAACCTGACAAAGGCAGAGAGAGGAGGACT-<br>GAGCGAACTGGACAAGGCAGGATTCATCAAGAGACAGCTGGTCGA<br>AACAAGACAGATCACAAAGCACGTCGCACAGATCCTGGACAGCAGAAT-<br>GAACACAAAGTACGACGAAAACGACAAGCTGATCAGAGAAGTCAAG<br>GTCATCACACTGAAGAGCAAGCTGGTCAGCGACTTCAGAAAGGACTTCCAGTTCTA-<br>CAAGGTCAGAGAAATCAACAACTACCACCACGCACACG<br>ACGCATACCTGAACGCAGTCGTCGGAACAGCACTGATCAAGAAGTACCCGAAGCTG-<br>GAAAGCGAATTCGTCTACGGAGACTACAAGGTCTACGA<br>CGTCAGAAAGATGATCGCAAAGAGCGAACAGGAAATCG-<br>GAAAGGCAACAGCAAAGTACTTCTTCTACAGCAACATCATGAACTTCTTCAAGACA<br>GAAATCACACTGGCAAACGGAGAAATCAGAAAGAGACCGCTGATCGAAACAAACG-<br>GAGAAACAGGAGAAATCGTCTGGGACAAGGGAAGAGACT<br>TCGCAACAGTCAGAAAGGTCCTGAGCATGCCGCAGGTCAACATCGTCAAGAA-<br>GACAGAAGTCCAGACAGGAGGATTCAGCAAGGAAAGCATCCT<br>GCCGAAGAGAAACAGCGACAAGCT-<br>GATCGCAAGAAAGAAGGACTGGGACCCGAAGAAGTACGGAGGATTCGACAGCCCGACAGTCGCATACAGC<br>GTCCTGGTCGTCGCAAAGGTCGAAAAGGGAAAGAGCAAGAAGCTGAAGAGCGT-<br>CAAGGAACTGCTGGGAATCACAATCATGGAAAGAAGCAGCT<br>TCGAAAAGAACCCGATCGACTTCCTGGAAGCAAAGGGATACAAGGAAGT-<br>CAAGAAGGACCTGATCATCAAGCTGCCGAAGTACAGCCTGTTCGA<br>ACTGGAAAACGGAAGAAAGAGAATGCTGGCAAGCGCAGGAGAACTGCAGAAGG-<br>GAAACGAACTGGCACTGCCGAGCAAGTACGTCAACTTCCTG<br>TACCTGGCAAGCCACTACGAAAAGCTGAAGGGAAGCCCGGAA-<br>GACAACGAACAGAAGCAGCTGTTCGTCGAACAGCACAAGCACTACCTGGACG<br>AAATCATCGAACAGATCAGCGAATTCAGCAAGAGAGTCATCCTGGCA-<br>GACGCAAACCTGGACAAGGTCCTGAGCGCATACAACAAGCACAGAGA<br>CAAGCCGATCAGAGAACAGGCAGAAAACATCATCCACCTGTTCACACTGACAAACCTGG-<br>GAGCACCGGCAGCATTCAAGTACTTCGACACAACA<br>ATCGACAGAAAGAGATACACAAGCACAAAGGAAGTCCTGGACGCAACACTGATC-<br>CACCAGAGCATCACAGGACTGTACGAAACAAGAATCGACC<br>TGAGCCAGCTGGGAGGAGACGGAGGAG-<br>GAAGCCCGAAGAAGAAGAGAAAGGTCAGCGAAAGCGCAACACCGGAAAGCGTCAGCGGATGGAGACT<br>GTTCAAGAAGATCAGCTAGCTAGCCATCACATTTAAAAGCATCTCAGCCTACCAT-<br>GAGAATAAGAGAAAGAAATGAAGATCAATAGCTTATTC<br>ATCTCTTTTTCTTTTTCGTTGGTGTAAAGCCAACACCCTGTCTAAAAAACATAAAT-<br>TTCTTTAATCATTTTGCCTCTTTTCTCTGTGCTTCAAT<br>TAATAAAAAATG-<br>GAAAGAACCTCGAGAAAAAAAAAAAAAAAAAAAAAAAAAAAAAAAAAAAAAAAAAAAAAAAAAAAAAAA<br>AAAAAAAAAAAAAAAAAAAAAAAAAAAAAA | |
| mRNA transcript with ORF encoding Cas9 with HiBiT tag, HBA 5' UTR and human ALB 3' UTR | GGGCATAAACCCTGGCGCGCTCGCGGCCCGGCACTCTTCTGGTCCCCACA-<br>GACTCAGAGAGAACCCACCCGCCACCATGGACAAGAAGTACAGC<br>ATCGGACTGGACATCGGAACAAACAGCGTCGGATGGGCAGTCATCACAGACGAATA-<br>CAAGGTCCCGAGCAAGAAGTTCAAGGTCCTGGGAAACA<br>CAGACAGACACAGCATCAAGAAGAACCTGATCGGAGCACTGCTGTTCGACAGCG-<br>GAGAAACAGCAGAAGCAACAAGACTGAAGAGAACAGCAAG<br>AAGAAGATACAAGAAGAAAGAACAGAATCTGCTACCTGCAG-<br>GAAATCTTCAGCAACGAAATGGCAAAGGTCGACGACAGCTTCTTCCACAGA<br>CTGGAAGAAAGCTTCCTGGTCGAAGAAGACAAGAAGCACGAAAGACACCCGATCTTCG-<br>GAAACATCGTCGACGAAGTCGCATACCACGAAAAGT<br>ACCCGACAATCTACCACCTGAGAAAGAAGCTGGTCGACAGCACAGACAAGGCAGACCTGA-<br>GACTGATCTACCTGGCACTGGCACACATGATCAA<br>GTTCAGAGGACACTTCCTGATCGAAGGAGACCT-<br>GAACCCGGACAACAGCGACGTCGACAAGCTGTTCATCCAGCTGGTCCAGACATACAACCAG<br>CTGTTCGAAGAAACCCGATCAACGCAAGCGGAGTCGACGCAAAGGCAATCCT-<br>GAGCGCAAGACTGAGCAAGAGCAGAAGACTGGAAAACCTGA<br>TCGCACAGCTGCCGGGAGAAAAGAAGAACGGACTGTTCGGAAACCTGATCGCACT-<br>GAGCCTGGGACTGACACCGAACTTCAAGAGCAACTTCGA<br>CCTGGCAGAAGACGCAAAGCTGCAGCTGAGCAAGGACACAT-<br>ACGACGACGACCTGGACAACCTGCTGGCACAGATCGGAGACCAGTACGCAGAC<br>CTGTTCCTGGCAGCAAAGAACCTGAGCGACGCAATCCTGCTGAGCGACATCCTGAGAGT-<br>CAACACAGAAATCACAAAGGCACCGCTGAGCGCAA<br>GCATGATCAAGAGATACGACGAACACCACCAGGACCTGACACTGCTGAAGGCACTGGTCA-<br>GACAGCAGCTGCCGGAAAAGTACAAGGAAATCTT<br>CTTCGACCAGAGCAAGAACGGATACGCAGGATACATCGACGGAGGAGCAAGCCAG-<br>GAAGAATTCTACAAGTTCATCAAGCCGATCCTGGAAAAG<br>ATGGACGGAACAGAAGAACTGCTGGTCAAGCTGAACAGAGAAGACCTGCT-<br>GAGAAAGCAGAGAACATTCGACAACGGAAGCATCCCGCACCAGA<br>TCCACCTGGGAGAACTGCACGCAATCCTGAGAAGACAGGAAGACTTCTACCCGTTCCT-<br>GAAGGACAACGAGAAAAGATCGAAAAGATCCTGAC<br>ATTCAGAATCCCGTACTACGTCGGACCGCTGGCAAGAGGAAACAGCAGATTCGCATG-<br>GATGACAAGAAAGAGCGAAGAACAATCACACCGTGG<br>AACTTCGAAGAAGTCGTCGACAAGGGAGCAAGCGCACAGAGCTT-<br>CATCGAAAGAATGACAAACTTCGACAAGAACCTGCCGAACGAAAAGGTCC | 183 |

-continued

Sequence Table
The following sequence table provides a listing of sequences disclosed herein. It is understood that if a DNA sequence (comprising Ts) is referenced with respect to an RNA, then Ts should be replaced with Us(which may be modified or unmodified depending on the context), and vice versa.

| Description | Sequence | SEQ ID No. |
|---|---|---|
| | TGCCGAAGCACAGCCTGCTGTACGAATACTTCACAGTCTACAACGAACTGACAAAGGT-CAAGTACGTCACAGAAGGAATGAGAAAGCCGGCATT CCTGAGCGGAGAACAGAAGAAGGCAATCGTCGACCTGCTGTTCAAGACAAACAGAAAGGT-CACAGTCAAGCAGCTGAAGGAAGACTACTTCAAG AAGATCGAATGCTTCGACAGCGTCGAAATCAGCGGAGTCGAAGACAGATT-CAACGCAAGCCTGGAACATACCACGACCTGCTGAAGATCATCA AGGACAAGGACTTCCTGGACAACGAAGAAAACGAAGACATCCTGGAAGA-CATCGTCCTGACACTGACACTGTTCGAAGACAGAGAAATGATCGA AGAAAGACTGAAGACATACGCACACCTGTTCGACGACAAGGTCATGAAGCAGCT-GAAGAGAAGAAGATACACAGGATGGGGAAGACTGAGCAGA AAGCTGATCAACGGAATCAGAGACAAGCAGAGCGGAAAGACAATCCTGGACTTCCT-GAAGAGCGACGGATTCGCAAACAGAAACTTCATGCAGC TGATCCACGACGACAGCCTGACATTCAAGGAAGA-CATCCAGAAGGCACAGGTCAGCGGACAGGGAGACAGCCTGCACGAACACATCGCAAACCT GGCAGGAAGCCCGGCAATCAAGAAGGGAATCCTGCAGACAGT-CAAGGTCGTCGACGAACTGGTCAAGGTCATGGGAAGACACAAGCCGGAAAAC ATCGTCATCGAAATGGCAAGAGAAAACCA-GACAACACAGAAGGGACAGAAGAACAGCAGAGAAAGAATGAAGAGAATCGAAGAAGGAATCAAGG AACTGGGAAGCCAGATCCT-GAAGGAACACCCGGTCGAAAACACACAGCTGCAGAACGAAAAGCTGTACCTGTACTACCTGCAGAACGGAAGAGA CATGTACGTCGACCAGGAACTGGACATCAACAGACTGAGCGACTACGACGTCGACCA-CATCGTCCCGCAGAGCTTCCTGAAGGACGACAGCATC GACAACAAGGTCCTGACAAGAAGCGACAAGAACAGAG-GAAAGAGCGACAACGTCCCGAGCGAAGAAGTCGTCAAGAAGATGAAGAACTACTGGA GACAGCTGCTGAACGCAAAGCTGAT-CACACAGAGAAAGTTCGACAACCTGACAAAGGCAGAGAGAGGAGGACTGAGCGAACTGGACAAGGCAGG ATTCATCAAGAGACAGCTGGTCGAAACAAGACAGATCACAAAGCACGTCGCACA-GATCCTGGACAGCAGAATGAACACAAAGTACGACGAAAAC GACAAGCTGATCAGAGAAGTCAAGGTCATCACACT-GAAGAGCAAGCTGGTCAGCGACTTCAGAAAGGACTTCCAGTTCTACAAGGTCAGAGAAA TCAACAACTACCACCACGCACACGACGCATACCTGAACGCAGTCGTCGGAACAGCACT-GATCAAGAAGTACCCGAAGCTGGAAAGCGAATTCGT CTACGGAGACTACAAGGTCTACGACGTCAGAAAGATGATCGCAAAGAGCGAACAG-GAAATCGGAAAGGCAACAGCAAAGTACTTCTTCTACAGC AACATCATGAACTTCTTCAAGACAGAAATCACACTGGCAAACGGAGAAATCAGAAAGA-GACCGCTGATCGAAACAAACGGAGAAACAGGAGAAA TCGTCTGGGACAAGGGAAGAGACTTCGCAACAGTCAGAAAGGTCCTGAG-CATGCCGCAGGTCAACATCGTCAAGAAGACAGAAGTCCAGACAGG AGGATTCAGCAAGGAAAGCATCCTGCCGAAGAGAAACAGCGACAAGCT-GATCGCAAGAAAGAAGGACTGGGACCCGAAGAAGTACGGAGGATTC GACAGCCCGACAGTCGCATACAGCGTCCTGGTCGTCGCAAAGGTCGAAAAGG-GAAAGAGCAAGAAGCTGAAGAGCGTCAAGGAACTGCTGGGAA TCACAATCATGGAAAGAAGCAGCTTCGAAAAGAACCCGATCGACTTCCTGGAAGCAAAGG-GATACAAGGAAGTCAAGAAGGACCTGATCATCAA GCTGCCGAAGTACAGCCTGTTCGAACTGGAAAACG-GAAGAAAGAGAATGCTGGCAAGCGCAGGAGAACTGCAGAAGGGAAACGAACTGGCACTG CCGAGCAAGTACGTCAACTTCCTGTACCTGGCAAGCCACTACGAAAAGCTGAAGG-GAAGCCCGGAAGACAACGAACAGAAGCAGCTGTTCGTCG AACAGCACAAGCACTACCTGGACGAAATCATCGAACAGATCAGCGAAT-TCAGCAAGAGAGTCATCCTGGCAGACGCAAACCTGGACAAGGTCCT GAGCGCATACAACAAGCACAGAGACAAGCCGATCAGAGAACAGGCAGAAAACATCATC-CACCTGTTCACACTGACAAACCTGGGAGCACCGGCA GCATTCAAGTACTTCGACACAACAATCGACAGAAAGAGATA-CACAAGCACAAAGGAAGTCCTGGACGCAACACTGATCCACCAGAGCATCACAG GACTGTACGAAACAAGAATCGACCTGAGCCAGCTGGGAGGAGACGGAGGAG-GAAGCCCGAAGAAGAAGAGAAAGGTCAGCGAAAGCGCAACACC GGAAAGCGTCAGCGGATGGAGACTGTTCAAGAAGATCAGCTAGCTAGCCATCACATT-TAAAAGCATCTCAGCCTACCATGAGAATAAGAGAAAG AAAATGAAGATCAATAGCTTATTCATCTCTTTTTCTTTTTCGTTGGTGTAAAGC-CAACACCCTGTCTAAAAAACATAAATTTCTTTAATCATTT TGCCTCTTTTCTCTGTGCTTCAATTAATAAATG-GAAAGAACCTCGAGAAAAAAAAAAAAAAAAAAAAAAAAAAAAAAAAAAAAAAAAAAAA AAAAAAAAAAAAAAAAAAAAAAAAAAAAAAAAAAAAAAAAAAAAA | |
| mRNA transcript with ORF encoding | GGGACATTTGCTTCTGACACAACTGTGTTCACTAGCAACCTCAAACAGACACCG-GATCTCGCCACCATGGACAAGAAGTACAGCATCGGACTGG ACATCGGAACAAACAGCGTCGGATGGGCAGTCATCACAGACGAATA-CAAGGTCCCGAGCAAGAAGTTCAAGGTCCTGGGAAACACAGACAGACA CAGCATCAAGAAGAACCTGATCGGAGCACTGCTGTTCGACAGCG-GAGAAAACAGCAGAAGCAACAAGACTGAAGAGAACAGCAAGAAGAAGATAC ACAAGAAGAAAGAACAGAATCTGCTACCTGCAG-GAAATCTTCAGCAACGAAATGGCAAAGGTCGACGACAGCTTCTTCCACAGACTGGAAGAAA GCTTCCTGGTCGAAGAAGACAAGAAGCACGAAAGACACCCGATCTTCGGAAA-CATCGTCGACGAAGTCGCATACCACGAAAAGTACCCGACAAT CTACCACCTGAGAAAGAAGCTGGTCGACAGCACAGACAAGGCAGACCTGAGACTGATC-TACCTGGCACTGGCACACATGATCAAGTTCAGAGGA | 184 |

-continued

Sequence Table
The following sequence table provides a listing of sequences disclosed herein. It is understood that if a DNA sequence (comprising Ts) is referenced with respect to an RNA, then Ts should be replaced with Us(which may be modified or unmodified depending on the context), and vice versa.

| Description | Sequence | SEQ ID No. |
|---|---|---|
| coding Cas9 with HiBiT tag, HBA 5' UTR and human ALB 3' UTR | CACTTCCTGATCGAAGGAGACCTGAACCCGGACAACAGCGACGTCGACAAGCTGTT-<br>CATCCAGCTGGTCCAGACATACAACCAGCTGTTCGAAG<br>AAAACCCGATCAACGCAAGCGGAGTCGACGCAAAGGCAATCCTGAGCGCAAGACT-<br>GAGCAAGAGCAGAAGACTGGAAAACCTGATCGCACAGCT<br>GCCGGGAGAAAAGAAGAACGGACTGTTCGGAAACCTGATCGCACT-<br>GAGCCTGGGACTGACACCGAACTTCAAGAGCAACTTCGACCTGGCAGAA<br>GACGCAAAGCTGCAGCTGAGCAAGGACACAT-<br>ACGACGACGACCTGGACAACCTGCTGGCACAGATCGGAGACCAGTACGCAGACCTGTTCCTGG<br>CAGCAAAGAACCTGAGCGACGCAATCCTGCTGAGCGACATCCTGAGAGT-<br>CAACACAGAAATCACAAAGGCACCGCTGAGCGCAAGCATGATCAA<br>GAGATACGACGAACACCACCAGGACCTGACACTGCTGAAGGCACTGGTCA-<br>GACAGCAGCTGCCGGAAAAGTACAAGGAAATCTTCTTCGACCAG<br>AGCAAGAACGGATACGCAGGATACATCGACGGAGGAGCAAGCCAGGAAGAATTCTA-<br>CAAGTTCATCAAGCCGATCCTGGAAAAGATGGACGGAA<br>CAGAAGAACTGCTGGTCAAGCTGAACAGAGAAGACCTGCTGAGAAAGCAGAGAACAT-<br>TCGACAACGGAAGCATCCCGCACCAGATCCACCTGGG<br>AGAACTGCAGCGCAATCCTGAGAAGACAGGAAGACTTCTACCCGTTCCT-<br>GAAGGACAACAGAGAAAAGATCGAAAAGATCCTGACATTCAGAATC<br>CCGTACTACGTCGGACCGCTGGCAAGAGGGAAACAGCAGATTCGCATG-<br>GATGACAAGAAAGAGCGAAGAAACAATCACACCGTGGAACTTCGAAG<br>AAGTCGTCGACAAGGGAGCAAGCGCACAGAGCTT-<br>CATCGAAAGAATGACAAACTTCGACAAGAACCTGCCGAACGAAAAGGTCCTGCCGAAGCA<br>CAGCCTGCTGTACGAATACTTCACAGTCTACAACGAACTGACAAAGGTCAAGTACGT-<br>CACAGAAGGAATGAGAAAGCCGGCATTCCTGAGCGGA<br>GAACAGAAGAAGGCAATCGTCGACCTGCTGTTCAAGACAAACAGAAAGGTCACAGT-<br>CAAGCAGCTGAAGGAAGACTACTTCAAGAAGATCGAAT<br>GCTTCGACAGCGTCGAAATCAGCGGAGTCGAAGACAGATTCAACGCAAGCCTGGGAACAT-<br>ACCACGACCTGCTGAAGATCATCAAGGACAAGGA<br>CTTCCTGGACAACGAAGAAAACGAAGACATCCTGGAAGA-<br>CATCGTCCTGACACTGACACTGTTCGAAGACAGAGAAATGATCGAAGAAAGACTG<br>AAGACATACGCACACCTGTTCGACGACAAGGTCATGAAGCAGCTGAAGAGAAGAAGATA-<br>CACAGGATGGGGAAGACTGAGCAGAAAGCTGATCA<br>ACGGAATCAGAGACAAGCAGAGCGGAAAGACAATCCTGGACTTCCTGAAGAGCGACGGAT-<br>TCGCAAACAGAAACTTCATGCAGCTGATCCACGA<br>CGACAGCCTGACATTCAAGGAAGACATCCAGAAGGCACAGGTCAGCGGACAGGGA-<br>GACAGCCTGCACGAACACATCGCAAACCTGGCAGGAAGC<br>CCGGCAATCAAGAAGGGAATCCTGCAGACAGTCAAGGTCGTCGACGAACTGGTCAAGGT-<br>CATGGGAAGACACAAGCCGGAAAACATCGTCATCG<br>AAATGGCAAGAGAAACCAGACAACACAGAAGGGACAGAAGAACAGCAGAGAAAGAAT-<br>GAAGAGAATCGAAGAAGGAATCAAGGAACTGGGAAG<br>CCAGATCCT-<br>GAAGGAACACCCGGTCGAAAACACACAGCTGCAGAACGAAAAGCTGTACCTGTACTACCTGCAGAACGGAAGAGACATGTACGTC<br>GACCAGGAACTGGACATCAACAGACTGAGCGACTACGACGTCGACCA-<br>CATCGTCCCGCAGAGCTTCCTGAAGGACGACAGCATCGACAACAAGG<br>TCCTGACAAGAAGCGACAAGAACAGAG-<br>GAAAGAGCGACAACGTCCCGAGCGAAGAAGTCGTCAAGAAGATGAAGAACTACTGGAGACAGCTGCT<br>GAACGCAAAGCTGATCACACAGAGAAAGTTCGACAACCTGACAAAGGCAGAGAGAG-<br>GAGGACTGAGCGAACTGGACAAGGCAGGATTCATCAAG<br>AGACAGCTGGTCGAAACAAGACAGATCACAAAGCACGTCGCACA-<br>GATCCTGGACAGCAGAATGAACACAAAGTACGACGAAAACGACAAGCTGA<br>TCAGAGAAGTCAAGGTCATCACACT-<br>GAAGAGCAAGCTGGTCAGCGACTTCAGAAAGGACTTCCAGTTCTACAAGGTCAGAGAAATCAACAACTA<br>CCACCACGCACACGACGCATACCTGAACGCAGTCGTCGGAACAGCACTGAT-<br>CAAGAAGTACCCGAAGCTGGAAAGCGAATTCGTCTACGGAGAC<br>TACAAGGTCTACGACGTCAGAAAGATGATCGCAAAGAGCGAACAGGAAATCG-<br>GAAAGGCAACAGCAAAGTACTTCTTCTACAGCAACATCATGA<br>ACTTCTTCAAGACAGAAATCACACTGGCAAACGGAGAAATCAGAAAGAGACCGCT-<br>GATCGAAACAAACGGAGAAACAGGAGAAATCGTCTGGGA<br>CAAGGGAAGAGACTTCGCAACAGTCAGAAAGGTCCTGAGCATGCCGCAGGTCAACATCGT-<br>CAAGAAGACAGAAGTCCAGACAGGAGGATTCAGC<br>AAGGAAAGCATCCTGCCGAAGAGAAACAGCGACAAGCT-<br>GATCGCAAGAAAGAAGGACTGGGACCCGAAGAAGTACGGAGGATTCGACAGCCCGA<br>CAGTCGCATACAGCGTCCTGGTCGTCGCAAAGGTCGAAAAGGGAAAGAGCAAGAAGCT-<br>GAAGAGCGTCAAGGAACTGCTGGGAATCACAATCAT<br>GGAAAGAAGCAGCTTCGAAAAGAACCCGATCGACTTCCTGGAAGCAAAGGGATA-<br>CAAGGAAGTCAAGAAGGACCTGATCATCAAGCTGCCGAAG<br>TACGCCTGTTCGAACTGGAAAACGGAAGAAAGAGAATGCTGGCAAGCGCAG-<br>GAGAACTGCAGAAGGGAAACGAACTGGCACTGCCGAGCAAGT<br>ACGTCAACTTCCTGTACCTGGCAAGCCACTACGAAAAGCTGAAGGGAAGCCCGGAA-<br>GACAACGAACAGAAGCAGCTGTTCGTCGAACAGCACAA<br>GCACTACCTGGACGAAATCATCGAACAGATCAGCGAATTCAGCAAGAGAGT-<br>CATCCTGGCAGACGCAAACCTGGACAAGGTCCTGAGCGCATAC<br>AACAAGCACAGAGACAAGCCGATCAGAGAACAGGCAGAAAACATCATCCACCTGTT-<br>CACACTGACAAACCTGGGAGCACCGGCAGCATTCAAGT<br>ACTTCGACACAACAATCGACAGAAAGAGATA-<br>CACAAGCACAAAGGAAGTCCTGGACGCAACACTGATCCACCAGAGCATCACAGGACTGTACGA | |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
| --- | --- | --- |
| | AACAAGAATCGACCTGAGCCAGCTGGGAGGAGACGGAGGAG-GAAGCCCGAAGAAGAAGAGAAAGGTCAGCGAAAGCGCAACACCGGAAAGCGTCAGCGGATGGAGACTGTTCAAGAAGATCAGCTAGCTAGCCATCACATTTAAAAGCATCTCAGCCTACCATGAGAATAAGAGAAAGAAAATGAAGATCAATAGCTTATTCATCTCTTTTTCTTTTTCGTTGGTGTAAAGC-CAACACCCTGTCTAAAAAACATAAATTTCTTTAATCATTTTGCCTCTTTTCTCTGTGCTTCAATTAATAAAAAATG-GAAAGAACCTCGAGAAAAAAAAAAAAAAAAAAAAAAAAAAAAAAAAAAAAAAAAAAAAAAAAAAAAAAAAAAAAAAAAAAAAAAAAAAAAAAAAAAAAAAAAA | |
| mRNA transcript with ORF encoding Cas9 with HiBiT tag, XBG 5' UTR and human ALB 3' UTR | GGGAAGCTCAGAATAAACGCTCAACTTTGGCCGGATCTCGCCACCATGGACAAGAAGTACAGCATCGGACTGGACATCGGAACAAACAGCGTCGGATGGGCAGTCATCACAGACGAATACAAGGTCCCGAGCAAGAAGTTCAAGGTCCTGGGAAACACAGACAGACAGCATCAAGAAGAACCTGATCGGAGCACTGCTGTTCGACAGCGGAGAAACAGCAGAAGCAACAAGACTGAAGAGAACAGCAAGAAGATACACAAGGAAGAAGAACAGAATCTGCTACCTGCAGGAAATCTTCAGCAACGAAATGGCAAAGGTCGACGACAGCTTCTTCCACAGACTGGAAGAAAGCTTCCTGGTCGAAGAAGACAAGAAGCACGAAAGCACCCGATCTTCGGAAACATCGTCGACGAAGTCGCATACCACGAAAAGTACCCGACAATCTACCACCTGAGAAAGAAGCTGGTCGACAGCACAGACAAGGCAGACCTGAGACTGATCTACCTGGCACTGGCACACATGATCAAGTTCAGAGGACACTTCCTGATCGAAGGAGACCTGAACCCGGACAACAGCGACGTCGACAAGCTGTTCATCCAGCTGGTCCAGACATACAACCAGCTGTTCGAAGAAAACCCGATCAACGCAAGCGGAGTCGACGCAAAGGCAATCCTGAGCGCAAGACTGAGCAAGAGCAGAAGACTGGAAAACCTGATCGCACAGCTGCCGGGAGAAAAGAAGAACGGACTGTTCGGAAACCTGATCGCACTGAGCCTGGGACTGACACCGAACTTCAAGAGCAACTTCGACCTGGCAGAAGACGCAAAGCTGCAGCTGAGCAAGGACACATACGACGACGACCTGGACAACCTGCTGGCACAGATCGGAGACCAGTACGCAGACCTGTTCCTGGCAGCAAAGAACCTGAGCGACGCAATCCTGCTGAGCGACATCCTGAGAGTCAACACAGAAATCACAAAGGCACCGCTGAGCGCAAGCATGATCAAGAGATACGACGAACACCACCAGGACCTGACACTGCTGAAGGCACTGGTCAGACAGCAGCTGCCGGAAAAGTACAAGGAAATCTTCTTCGACCAGAGCAAGAACGGATACGCAGGATACATCGACGGAGGAGCAAGCCAGGAAGAATTCTACAAGTTCATCAAGCCGATCCTGGAAAAGATGGACGGAACAGAAGAACTGCTGGTCAAGCTGAACAGAGAAGACCTGCTGAGAAAGCAGAGAACATTCGACAACGGAAGCATCCCGCACCAGATCACCCTGGGAGAACTGCACGCAATCCTGAGAAGACAGGAAGACTTCTACCCGTTCCTGAAGGACAACAGAGAAAAGATCGAAAAGATCCTGACATTCAGAATCCCGTACTACGTCGGACCGCTGGCAAGAGGAAACAGCGAGATTCGCATGGATGACAAGAAAGAGCGAAGAAACAATCACACCGTGGAACTTCGAAGAAGTCGTCGACAAGGGAGCAAGCGCACACAGAGCTT-CATCGAAAGAATGACAAACTTCGACAAGAACCTGCCGAACGAAAAGGTCCTGCCGAAGCACAGCCTGCTGTACGAATACTTCACAGTCTACAACGAACTGACAAAGGTCAAGTACGTCACAGAAGGAATGAGAAAGCCGGCATTCCTGAGCGGAGAACAGAAGAAGGCAATCGTCGACCTGCTGTTCAAGACAAACAGAAAGGTCACAGTCAAGCAGCTGAAGGAAGACTACTTCAAGAAGATCGAATGCTTCGACAGCGTCGAAATCAGCGGAGTCGAAGACAGATTCAACGCAAGCCTGGGAACATACCACGACCTGCTGAAGATCATCAAGGACAAGGACTTCCTGGACAACGAAGAAACGAAGCACATCCTGGAAGACATCGTCCTGACACTGACACTGTTCGAAGACAGAGAAATGATCGAAAAGACTGAAGACATACGCACACCTGTTCGACGACAAGGTCATGAAGCAGCTGAAGAGAAGAAGATACACAGGATGGGGAAGACTGAGCAGAAAGCTGATCAACGGAATCAGAGACAAGCAGAGCGGAAAAGACAATCCTGGACTTCCTGAAGAGCGACGGATTCGCAAACAGAAACTTCATGCAGCTGATCCACGACGACAGCCTGACATTCAAGGAAGACATCCAGAAGGCACAGGTCAGCGGACAGGGAGACAGCCTGCACGAACACATCGCAAACCTGGCAGGAAGCCCGGCAATCAAGAAGGGAATCCTGCAGACAGTCAAGGTCGTCGACGAACTGGTCAAGGTCATGGGAAGACACAAGCCGGAAAACATCGTCATCGAAATGGCAAGAGAAAACCAGACAACACAGAAGGGACAGAAGAACAGCAGAGAAAGAATGAAGAGAATCGAAGAGGAATCAAGGAACTGGGAAGCCAGATCCTGAAGGAACACCCGGTCGAAAACACACAGCTGCAGAACGAAAAGCTGTACCTGTACTACCTGCAGAACGGAAGAGACATGTACGTCGACCAGGAACTGGACATCAACAGACTGAGCGACTACGACGTCGACCACATCGTCCCGCAGAGCTTCCTGAAGGACGACAGCATCGACAACAAGGTCCTGACAAGAAGCGACAAGAACAGAGGAAAGAGCGACAACGTCCCGAGCGAAGAAGTCGTCAAGAAGATGAAGAACTACTGGAGACAGCTGCTGAACGCAAAGCTGATCACACAGAGAAAGTTCGACAACCTGACAAAGGCAGAGAGAGGAGGACTGAGCGAACTGGACAAGGCAGGATTCATCAAGAGACAGCTGGTCGAAACAAGACAGATCACAAAGCACGTCGCACAGATCCTGGACAGCAGAATGAACACAAAGTACGACGAAAACGACAAGCTGATCAGAGAAGTCAAGGTCATCACACTGAAGAGCAAGCTGGTCAGCGACTTCAGAAAGGACTTCCAGTTCTACAAGGTCAGAGAAATCAACAACTACCACCACGCACACGACGCATACCTGAACGCAGTCGTCGGAACAGCACTGATCAAGAAGTACCCGAAGCTGGAAAGCGAATTCGTCTACGGAGACTACAAGGTCTACGACGTCAGA | 185 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| | AAGATGATCGCAAAGAGCGAACAGGAAATCGGAAAGGCAACAGCAAAGTACTTCTTCTA- | |
| | CAGCAACATCATGAACTTCTTCAAGACAGAAATCA | |
| | CACTGGCAAACGGAGAAATCAGAAAGAGACCGCTGATCGAAACAAACGGAGAAACAG- | |
| | GAGAAATCGTCTGGGACAAGGGAAGAGACTTCGCAAC | |
| | AGTCAGAAAGGTCCTGAGCATGCCGCAGGTCAACATCGTCAAGAAGACAGAAGTCCA- | |
| | GACAGGAGGATTCAGCAAGGAAAGCATCCTGCCGAAG | |
| | AGAAACAGCGACAAGCTGATCGCAAGAAAGAAGGACTGGGACCCGAAGAAGTACGGAG- | |
| | GATTCGACAGCCCGACAGTCGCATACAGCGTCCTGG | |
| | TCGTCGCAAAGGTCGAAAAGGGAAAGAGCAAGAAGCTGAAGAGCGTCAAGGAACTGCTGG- | |
| | GAATCACAATCATGGAAAGAAGCAGCTTCGAAAA | |
| | GAACCCGATCGACTTCCTGGAAGCAAAGGGATACAAGGAAGTCAAGAAGGACCTGATCAT- | |
| | CAAGCTGCCGAAGTACAGCCTGTTCGAACTGGAA | |
| | AACGGAAGAAAGAGAATGCTGGCAAGCGCAGGAGAACTGCAGAAGG- | |
| | GAAACGAACTGGCACTGCCGAGCAAGTACGTCAACTTCCTGTACCTGG | |
| | CAAGCCACTACGAAAAGCTGAAGGGAAGCCCGGAA- | |
| | GACAACGAACAGAAGCAGCTGTTCGTCGAACAGCACAAGCACTACCTGGACGAAATCAT | |
| | CGAACAGATCAGCGAATTCAGCAAGAGAGTCATCCTGGCA- | |
| | GACGCAAACCTGGACAAGGTCCTGAGCGCATACAACAAGCACAGAGACAAGCCG | |
| | ATCAGAGAACAGGCAGAAACATCATCCACCTGTTCACACTGACAAACCTGG- | |
| | GAGCACCGGCAGCATTCAAGTACTTCGACACAACAATCGACA | |
| | GAAAGAGATACACAAGCACAAAGGAAGTCCTGGACGCAACACTGATCCACCAGAGCAT- | |
| | CACAGGACTGTACGAAACAAGAATCGACCTGAGCCA | |
| | GCTGGGAGGAGACGGAGGAG- | |
| | GAAGCCCGAAGAAGAGAAAGGTCAGCGAAAGCGCAACACCGGAAAGCGTCAGCGGATGGAGACTGTTCAAG | |
| | AAGATCAGCTAGCTAGCCATCACATTTAAAAGCATCTCAGCCTACCAT- | |
| | GAGAATAAGAGAAAGAAAATGAAGATCAATAGCTTATTCATCTCTT | |
| | TTTCTTTTTCGTTGGTGTAAAGCCAACACCCTGTCTAAAAAACATAAATTTCTTTAAT- | |
| | CATTTTGCCTCTTTTCTCTGTGCTTCAATTAATAAA | |
| | AAATG- | |
| | GAAAGAACCTCGAGAAAAAAAAAAAAAAAAAAAAAAAAAAAAAAAAAAAAAAAAAAAAAAAAAAAAAAAAAAAA | |
| | AAAAAAAAAAAAAAAAAAAAAAAA | |
| Amino acid sequence for Cas9 with NLS1 | MDKKYSIGLDIGTNSVGWAVITDEYKVPSKKFKVLGNTDRHSIKKNLIGALLFDSGETAE-<br>ATRLKRTARRRYTRRKNRICYLQEIFSNEMAKVD<br>DSFFHRLEESFLVEEDKKHERHPIFGNIVDEVAYHEKYPTIYHLRKKLVD-<br>STDKADLRLIYLALAHMIKFRGHFLIEGDLNPDNSDVDKLFIQL<br>VQTYNQLFEENPINASGVDAKAILSARLSKSRRLENLIAQLPGEKKNGLEGNLIA-<br>LSLGLTPNEKSNFDLAEDAKLQLSKDTYDDDLDNLLAQI<br>GDQYADLFLAAKNLSDAILLSDILRVNTEITKAPLSASMIKRYDEHHQDLTLLKA-<br>LVRQQLPEKYKEIFFDQSKNGYAGYIDGGASQEEFYKFI<br>KPILEKMDGTEELLVKLNREDLLRKQRTFDNGSIPHQIHLGELHAILRRQEDFYPFLKDN-<br>REKIEKILTFRIPYYVGPLARGNSRFAWMTRKSE<br>ETITPWNFEEVVDKGASAQSFIERMTNEDKNLPNEKVLPKHSLLY-<br>EYFTVYNELTKVKYVTEGMRKPAELSGEQKKAIVDLLEKTNRKVTVKQL<br>KEDYFKKIECFDSVEISGVEDRFNASLGTYHDLLKIIKDKDFLDNEENEDILEDI-<br>VLTLTLFEDREMIEERLKTYAHLFDDKVMKQLKRRRYTG<br>WGRLSRKLINGIRDKQSGKTILDFLKSDGFANRNFMQLIHDDSLTEKEDIQKAQVSGQGD-<br>SLHEHIANLAGSPAIKKGILQTVKVVDELVKVMG<br>RHKPENIVIEMARENQTTQKGQKNSRERMKRIEEGIKELGSQILKEHPVENTQLQNEKLY-<br>LYYLQNGRDMYVDQELDINRLSDYDVDHIVPQSF<br>LKDDSIDNKVLTRSDKNRGKSDNVPSEEVVKKMKNYWRQLLNAKLITQRKEDNLTKAERG-<br>GLSELDKAGFIKRQLVETRQITKHVAQILDSRMN<br>TKYDENDKLIREVKVITLKSKLVSDERKDFQFYKVREINNYHHAHDAYLNAVVGTALIK-<br>KYPKLESEFVYGDYKVYDVRKMIAKSEQEIGKATA<br>KYFFYSNIMNFFKTEITLANGEIRKRPLIETNGETGEIVWDKGRDFA-<br>TVRKVLSMPQVNIVKKTEVQTGGFSKESILPKRNSDKLIARKKDWDP<br>KKYGGFDSPIVAYSVLVVAKVEKGKSKKLKSVKELLGITIMERSSFEKNPIDFLEA-<br>KGYKEVKKDLIIKLPKYSLFELENGRKRMLASAGELQK<br>GNELALPSKYVNFLYLASHYEKLKGSPEDNEQKQLFVEQHKHYLDEIIEQISEFSKR-<br>VILADANLDKVLSAYNKHRDKPIREQAENIIHLFILT<br>NLGAPAAFKYFDTTIDRKRYISTKEVLDATLIHQSITGLYETRIDLSQLGGDGGGSLAAKRSIT | 186 |
| Amino acid sequence for Cas9 with | MDKKYSIGLDIGTNSVGWAVITDEYKVPSKKFKVLGNIDRHSIKKNLIGALLFDSGETAE-<br>ATRLKRTARRRYTRRKNRICYLQEIFSNEMAKVD<br>DSFEHRLEESELVEEDKKHERHPIEGNIVDEVAYHEKYPTIYHLRKKLVD-<br>STDKADLRLIYLALAHMIKERGHFLIEGDLNPDNSDVDKLFIQL<br>VQTYNQLFEENPINASGVDAKAILSARLSKSRRLENLIAQLPGEKKNGLEGNLIA-<br>LSLGLIPNEKSNFDLAEDAKLQLSKDTYDDDLDNLLAQI<br>GDQYADLFLAAKNLSDAILLSDILRVNTEITKAPLSASMIKRYDEHHQDLILLKA-<br>LVRQQLPEKYKEIFFDQSKNGYAGYIDGGASQEEFYKFI<br>KPILEKMDGTEELLVKLNREDLLRKQRTFDNGSIPHQIHLGELHAILRRQEDFYPFLKDN-<br>REKIEKILTFRIPYYVGPLARGNSRFAWMTRKSE<br>ETITPWNFEEVVDKGASAQSFIERMINFDKNLPNEKVLPKHSLLY-<br>EYFTVYNELTKVKYVTEGMRKPAFLSGEQKKAIVDLLEKTNRKVIVKQL<br>KEDYFKKIECFDSVEISGVEDRFNASLGTYHDLLKIIKDKDFLDNEENEDILEDI-<br>VLILTLTLFEDREMIEERLKTYAHLFDDKVMKQLKRRRYTG | 187 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
| --- | --- | --- |
| NLS2 | WGRLSRKLINGIRDKQSGKTILDFLKSDGFANRNFMQLIHDDSLIFKEDIQKAQVSGQGD-<br>SLHEHIANLAGSPAIKKGILQTVKVVDELVKVMG<br>RHKPENIVIEMARENQTTQKGQKNSRERMKRIEEGIKELGSQILKEHPVENTQLQNEKLY-<br>LYYLQNGRDMYVDQELDINRLSDYDVDHIVPQSF<br>LKDDSIDNKVLIRSDKNRGKSDNVPSEEVVKKMKNYWRQLLNAKLITQRKEDNLIKAERG-<br>GLSELDKAGFIKRQLVETRQIIKHVAQILDSRMN<br>TKYDENDKLIREVKVITLKSKLVSDERKDFQFYKVREINNYHHAHDAYLNAVVGIALIK-<br>KYPKLESEFVYGDYKVYDVRKMIAKSEQEIGKATA<br>KYFFYSNIMNFFKTEITLANGEIRKRPLIETNGETGEIVWDKGRDFA-<br>TVRKVLSMPQVNIVKKTEVQTGGFSKESILPKRNSDKLIARKKDWDP<br>KKYGGFDSPIVAYSVLVVAKVEKGKSKKLKSVKELLGITIMERSSFEKNPIDFLEA-<br>KGYKEVKKDLIIKLPKYSLFELENGRKRMLASAGELQK<br>GNELALPSKYVNFLYLASHYEKLKGSPEDNEQKQLFVEQHKYLDEIIEQISEFSKR-<br>VILADANLDKVLSAYNKHRDKPIREQAENIIHLFILT<br>NLGAPAAFKYFDTTIDRKRYISTKEVLDATLIHQSITGLYETRIDLSQLGGDGGGSQAAKRSRIT | |
| Amino acid sequence for Cas9 with NLS3 | MDKKYSIGLDIGTNSVGWAVITDEYKVPSKKFKVLGNIDRHSIKKNLIGALLFDSGETAE-<br>ATRLKRTARRRYTRRKNRICYLQEIFSNEMAKVD<br>DSFEHRLEESELVEEDKKHERHPIEGNIVDEVAYHEKYPTIYHLRKKLVD-<br>STDKADLRLIYLALAHMIKERGHFLIEGDLNPDNSDVDKLFIQL<br>VQTYNQLFEENPINASGVDAKAILSARLSKSRRLENLIAQLPGEKKNGLEGNLIA-<br>LSLGLIPNEKSNFDLAEDAKLQLSKDTYDDDLDNLLAQI<br>GDQYADLFLAAKNLSDAILLSDILRVNTEITKAPLSASMIKRYDEHHQDLILLKA-<br>LVRQQLPEKYKEIFFDQSKNGYAGYIDGGASQEEFYKFI<br>KPILEKMDGTEELLVKLNREDLLRKQRTFDNGSIPHQIHLGELHAILRRQEDFYPFLKDN-<br>REKIEKILTFRIPYYVGPLARGNSRFAWMTRKSE<br>ETITPWNFEEVVDKGASAQSFIERMINFDKNLPNEKVLPKHSLLY-<br>EYFTVYNELTKVKYVTEGMRKPAFLSGEQKKAIVDLLEKTNRKVIVKQL<br>KEDYFKKIECFDSVEISGVEDRFNASLGTYHDLLKIIKDKDFLDNEENEDILEDI-<br>VLILTLFEDREMIEERLKTYAHLFDDKVMKQLKRRRYTG<br>WGRLSRKLINGIRDKQSGKTILDFLKSDGFANRNFMQLIHDDSLIFKEDIQKAQVSGQGD-<br>SLHEHIANLAGSPAIKKGILQTVKVVDELVKVMG<br>RHKPENIVIEMARENQTTQKGQKNSRERMKRIEEGIKELGSQILKEHPVENTQLQNEKLY-<br>LYYLQNGRDMYVDQELDINRLSDYDVDHIVPQSF<br>LKDDSIDNKVLIRSDKNRGKSDNVPSEEVVKKMKNYWRQLLNAKLITQRKEDNLIKAERG-<br>GLSELDKAGFIKRQLVETRQIIKHVAQILDSRMN<br>TKYDENDKLIREVKVITLKSKLVSDERKDFQFYKVREINNYHHAHDAYLNAVVGIALIK-<br>KYPKLESEFVYGDYKVYDVRKMIAKSEQEIGKATA<br>KYFFYSNIMNFFKTEITLANGEIRKRPLIETNGETGEIVWDKGRDFA-<br>TVRKVLSMPQVNIVKKTEVQTGGFSKESILPKRNSDKLIARKKDWDP<br>KKYGGFDSPIVAYSVLVVAKVEKGKSKKLKSVKELLGITIMERSSFEKNPIDFLEA-<br>KGYKEVKKDLIIKLPKYSLFELENGRKRMLASAGELQK<br>GNELALPSKYVNFLYLASHYEKLKGSPEDNEQKQLFVEQHKYLDEIIEQISEFSKR-<br>VILADANLDKVLSAYNKHRDKPIREQAENIIHLFILT<br>NLGAPAAFKYFDTTIDRKRYISTKEVLDATLIHQSITGLYETRIDLSQLGGDGGGSPAPAKRERTT | 188 |
| Amino acid sequence for Cas9 with NLS4 | MDKKYSIGLDIGINSVGWAVITDEYKVPSKKFKVLGNIDRHSIKKNLIGALLFDSGETAE-<br>ATRLKRTARRRYTRRKNRICYLQEIFSNEMAKVD<br>DSFEHRLEESELVEEDKKHERHPIEGNIVDEVAYHEKYPTIYHLRKKLVD-<br>STDKADLRLIYLALAHMIKERGHFLIEGDLNPDNSDVDKLFIQL<br>VQTYNQLFEENPINASGVDAKAILSARLSKSRRLENLIAQLPGEKKNGLEGNLIA-<br>LSLGLIPNEKSNFDLAEDAKLQLSKDTYDDDLDNLLAQI<br>GDQYADLFLAAKNLSDAILLSDILRVNTEITKAPLSASMIKRYDEHHQDLILLKA-<br>LVRQQLPEKYKEIFFDQSKNGYAGYIDGGASQEEFYKFI<br>KPILEKMDGTEELLVKLNREDLLRKQRTFDNGSIPHQIHLGELHAILRRQEDFYPFLKDN-<br>REKIEKILTFRIPYYVGPLARGNSRFAWMTRKSE<br>ETITPWNFEEVVDKGASAQSFIERMINFDKNLPNEKVLPKHSLLY-<br>EYFTVYNELTKVKYVTEGMRKPAFLSGEQKKAIVDLLEKTNRKVIVKQL<br>KEDYFKKIECFDSVEISGVEDRFNASLGTYHDLLKIIKDKDFLDNEENEDILEDI-<br>VLILTLFEDREMIEERLKTYAHLFDDKVMKQLKRRRYTG<br>WGRLSRKLINGIRDKQSGKTILDFLKSDGFANRNFMQLIHDDSLIFKEDIQKAQVSGQGD-<br>SLHEHIANLAGSPAIKKGILQTVKVVDELVKVMG<br>RHKPENIVIEMARENQTTQKGQKNSRERMKRIEEGIKELGSQILKEHPVENTQLQNEKLY-<br>LYYLQNGRDMYVDQELDINRLSDYDVDHIVPQSF<br>LKDDSIDNKVLIRSDKNRGKSDNVPSEEVVKKMKNYWRQLLNAKLITQRKEDNLIKAERG-<br>GLSELDKAGFIKRQLVETRQIIKHVAQILDSRMN<br>TKYDENDKLIREVKVITLKSKLVSDERKDFQFYKVREINNYHHAHDAYLNAVVGIALIK-<br>KYPKLESEFVYGDYKVYDVRKMIAKSEQEIGKATA<br>KYFFYSNIMNFFKTEITLANGEIRKRPLIETNGETGEIVWDKGRDFA-<br>TVRKVLSMPQVNIVKKTEVQTGGFSKESILPKRNSDKLIARKKDWDP<br>KKYGGFDSPIVAYSVLVVAKVEKGKSKKLKSVKELLGITIMERSSFEKNPIDFLEA-<br>KGYKEVKKDLIIKLPKYSLFELENGRKRMLASAGELQK<br>GNELALPSKYVNFLYLASHYEKLKGSPEDNEQKQLFVEQHKYLDEIIEQISEFSKR-<br>VILADANLDKVLSAYNKHRDKPIREQAENIIHLFILT<br>NLGAPAAFKYFDTTIDRKRYISTKEVLDATLIHQSITGLYETRIDLSQLGGDGGGSQAAKRPRIT | 189 |

-continued

Sequence Table
The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
| --- | --- | --- |
| Amino acid sequence for Cas9 with NLS5 | MDKKYSIGLDIGINSVGWAVITDEYKVPSKKFKVLGNIDRHSIKKNLIGALLFDSGETAE-ATRLKRTARRRYTRRKNRICYLQEIFSNEMAKVD<br>DSFEHRLEESELVEEDKKHERHPIEGNIVDEVAYHEKYPTIYHLRKKLVD-STDKADLRLIYLALAHMIKERGHFLIEGDLNPDNSDVDKLFIQL<br>VQTYNQLFEENPINASGVDAKAILSARLSKSRRLENLIAQLPGEKKNGLEGNLIA-LSLGLIPNEKSNFDLAEDAKLQLSKDTYDDDLDNLLAQI<br>GDQYADLFLAAKNLSDAILLSDILRVNTEITKAPLSASMIKRYDEHHQDLILLKA-LVRQQLPEKYKEIFFDQSKNGYAGYIDGGASQEEFYKFI<br>KPILEKMDGTEELLVKLNREDLLRKQRTFDNGSIPHQIHLGELHAILRRQEDFYPFLKDN-REKIEKILTFRIPYYVGPLARGNSRFAWMTRKSE<br>ETITPWNFEEVVDKGASAQSFIERMINFDKNLPNEKVLPKHSLLY-EYFTVYNELTKVKYVTEGMRKPAFLSGEQKKAIVDLLEKTNRKVIVKQL<br>KEDYFKKIECFDSVEISGVEDRFNASLGTYHDLLKIIKDKDFLDNEENEDILEDI-VLILTLFEDREMIEERLKTYAHLFDDKVMKQLKRRRYTG<br>WGRLSRKLINGIRDKQSGKTILDFLKSDGFANRNFMQLIHDDSLIFKEDIQKAQVSGQGD-SLHEHIANLAGSPAIKKGILQTVKVVDELVKVMG<br>RHKPENIVIEMARENQTTQKGQKNSRERMKRIEEGIKELGSQILKEHPVENTQLQNEKLY-LYYLQNGRDMYVDQELDINRLSDYDVDHIVPQSF<br>LKDDSIDNKVLIRSDKNRGKSDNVPSEEVVKKMKNYWRQLLNAKLITQRKEDNLIKAERG-GLSELDKAGFIKRQLVETRQIIKHVAQILDSRMN<br>TKYDENDKLIREVKVITLKSKLVSDERKDFQFYKVREINNYHHAHDAYLNAVVGIALIK-KYPKLESEFVYGDYKVYDVRKMIAKSEQEIGKATA<br>KYFFYSNIMNFFKTEITLANGEIRKRPLIETNGETGEIVWDKGRDFA-TVRKVLSMPQVNIVKKTEVQTGGFSKESILPKRNSDKLIARKKDWDP<br>KKYGGFDSPIVAYSVLVVAKVEKGKSKKLKSVKELLGITIMERSSFEKNPIDFLEA-KGYKEVKKDLIIKLPKYSLFELENGRKRMLASAGELQK<br>GNELALPSKYVNFLYLASHYEKLKGSPEDNEQKQLFVEQHKHYLDEIIEQISEFSKR-VILADANLDKVLSAYNKHRDKPIREQAENIIHLFILT<br>NLGAPAAFKYFDTTIDRKRYISTKEVLDATLIHQSITGLYETRIDLSQLGGDGGGSRAAKRPRIT | 190 |
| Amino acid sequence for Cas9 with NLS6 | MDKKYSIGLDIGINSVGWAVITDEYKVPSKKFKVLGNIDRHSIKKNLIGALLFDSGETAE-ATRLKRTARRYTRRKNRICYLQEIFSNEMAKVD<br>DSFEHRLEESELVEEDKKHERHPIEGNIVDEVAYHEKYPTIYHLRKKLVD-STDKADLRLIYLALAHMIKERGHFLIEGDLNPDNSDVDKLFIQL<br>VQTYNQLFEENPINASGVDAKAILSARLSKSRRLENLIAQLPGEKKNGLEGNLIA-LSLGLIPNEKSNFDLAEDAKLQLSKDTYDDDLDNLLAQI<br>GDQYADLFLAAKNLSDAILLSDILRVNTEITKAPLSASMIKRYDEHHQDLILLKA-LVRQQLPEKYKEIFFDQSKNGYAGYIDGGASQEEFYKFI<br>KPILEKMDGTEELLVKLNREDLLRKQRTFDNGSIPHQIHLGELHAILRRQEDFYPFLKDN-REKIEKILTFRIPYYVGPLARGNSRFAWMTRKSE<br>ETITPWNFEEVVDKGASAQSFIERMINFDKNLPNEKVLPKHSLLY-EYFTVYNELTKVKYVTEGMRKPAFLSGEQKKAIVDLLEKTNRKVIVKQL<br>KEDYFKKIECFDSVEISGVEDRFNASLGTYHDLLKIIKDKDFLDNEENEDILEDI-VLILTLFEDREMIEERLKTYAHLFDDKVMKQLKRRRYTG<br>WGRLSRKLINGIRDKQSGKTILDFLKSDGFANRNFMQLIHDDSLIFKEDIQKAQVSGQGD-SLHEHIANLAGSPAIKKGILQTVKVVDELVKVMG<br>RHKPENIVIEMARENQTTQKGQKNSRERMKRIEEGIKELGSQILKEHPVENTQLQNEKLY-LYYLQNGRDMYVDQELDINRLSDYDVDHIVPQSF<br>LKDDSIDNKVLIRSDKNRGKSDNVPSEEVVKKMKNYWRQLLNAKLITQRKEDNLIKAERG-GLSELDKAGFIKRQLVETRQIIKHVAQILDSRMN<br>TKYDENDKLIREVKVITLKSKLVSDERKDFQFYKVREINNYHHAHDAYLNAVVGIALIK-KYPKLESEFVYGDYKVYDVRKMIAKSEQEIGKATA<br>KYFFYSNIMNFFKTEITLANGEIRKRPLIETNGETGEIVWDKGRDFA-TVRKVLSMPQVNIVKKTEVQTGGFSKESILPKRNSDKLIARKKDWDP<br>KKYGGFDSPIVAYSVLVVAKVEKGKSKKLKSVKELLGITIMERSSFEKNPIDFLEA-KGYKEVKKDLIIKLPKYSLFELENGRKRMLASAGELQK<br>GNELALPSKYVNFLYLASHYEKLKGSPEDNEQKQLFVEQHKHYLDEIIEQISEFSKR-VILADANLDKVLSAYNKHRDKPIREQAENIIHLFILT<br>NLGAPAAFKYFDTTIDRKRYISTKEVLDATLIHQSITGLYETRIDLSQLGGDGGGSAAAKRSWSMAA | 191 |
| Amino acid sequence for Cas9 with NLS7 | MDKKYSIGLDIGINSVGWAVITDEYKVPSKKFKVLGNIDRHSIKKNLIGALLFDSGETAE-ATRLKRTARRYTRRKNRICYLQEIFSNEMAKVD<br>DSFEHRLEESELVEEDKKHERHPIEGNIVDEVAYHEKYPTIYHLRKKLVD-STDKADLRLIYLALAHMIKERGHFLIEGDLNPDNSDVDKLFIQL<br>VQTYNQLFEENPINASGVDAKAILSARLSKSRRLENLIAQLPGEKKNGLEGNLIA-LSLGLIPNEKSNFDLAEDAKLQLSKDTYDDDLDNLLAQI<br>GDQYADLFLAAKNLSDAILLSDILRVNTEITKAPLSASMIKRYDEHHQDLILLKA-LVRQQLPEKYKEIFFDQSKNGYAGYIDGGASQEEFYKFI<br>KPILEKMDGTEELLVKLNREDLLRKQRTFDNGSIPHQIHLGELHAILRRQEDFYPFLKDN-REKIEKILTFRIPYYVGPLARGNSRFAWMTRKSE<br>ETITPWNFEEVVDKGASAQSFIERMINFDKNLPNEKVLPKHSLLY-EYFTVYNELTKVKYVTEGMRKPAFLSGEQKKAIVDLLEKTNRKVIVKQL<br>KEDYFKKIECFDSVEISGVEDRFNASLGTYHDLLKIIKDKDFLDNEENEDILEDI-VLILTLFEDREMIEERLKTYAHLFDDKVMKQLKRRRYTG<br>WGRLSRKLINGIRDKQSGKTILDFLKSDGFANRNFMQLIHDDSLIFKEDIQKAQVSGQGD-SLHEHIANLAGSPAIKKGILQTVKVVDELVKVMG | 192 |

-continued

Sequence Table
The following sequence table provides a listing of sequences disclosed herein. It is understood that if a DNA sequence (comprising Ts) is referenced with respect to an RNA, then Ts should be replaced with Us(which may be modified or unmodified depending on the context), and vice versa.

| Description | Sequence | SEQ ID No. |
|---|---|---|
| | RHKPENIVIEMARENQTTQKGQKNSRERMKRIEEGIKELGSQILKEHPVENTQLQNEKLY-LYYLQNGRDMYVDQELDINRLSDYDVDHIVPQSF LKDDSIDNKVLIRSDKNRGKSDNVPSEEVVKKMKNYWRQLLNAKLITQRKEDNLIKAERG-GLSELDKAGFIKRQLVETRQIIKHVAQILDSRMN TKYDENDKLIREVKVITLKSKLVSDERKDFQFYKVREINNYHHAHDAYLNAVVGIALIK-KYPKLESEFVYGDYKVYDVRKMIAKSEQEIGKATA KYFFYSNIMNFFKTEITLANGEIRKRPLIETNGETGEIVWDKGRDFA-TVRKVLSMPQVNIVKKTEVQTGGFSKESILPKRNSDKLIARKKDWDP KKYGGFDSPIVAYSVLVVAKVEKGKSKKLKSVKELLGITIMERSSFEKNPIDFLEA-KGYKEVKKDLIIKLPKYSLFELENGRKRMLASAGELQK GNELALPSKYVNFLYLASHYEKLKGSPEDNEQKQLFVEQHKHYLDEIIEQISEFSKR-VILADANLDKVLSAYNKHRDKPIREQAENIIHLFILT NLGAPAAFKYFDTTIDRKRYISTKEVLDATLIHQSITGLYETRIDLSQLGGDGGGSAAAKRVWSMAF | |
| Amino acid sequence for Cas9 with NLS8 | MDKKYSIGLDIGINSVGWAVITDEYKVPSKKFKVLGNIDRHSIKKNLIGALLFDSGETAE-ATRLKRTARRRYTRRKNRICYLQEIFSNEMAKVD DSFEHRLEESELVEEDKKHERHPIEGNIVDEVAYHEKYPTIYHLRKKLVD-STDKADLRLIYLALAHMIKERGHFLIEGDLNPDNSDVDKLFIQL VQTYNQLFEENPINASGVDAKAILSARLSKSRRLENLIAQLPGEKKNGLEGNLIA-LSLGLIPNEKSNFDLAEDAKLQLSKDTYDDDLDNLLAQI GDQYADLFLAAKNLSDAILLSDILRVNTEITKAPLSASMIKRYDEHHQDLILLKA-LVRQQLPEKYKEIFFDQSKNGYAGYIDGGASQEEFYKFI KPILEKMDGTEELLVKLNREDLLRKQRTFDNGSIPHQIHLGELHAILRRQEDFYPFLKDN-REKIEKILTFRIPYYVGPLARGNSRFAWMTRKSE ETITPWNFEEVVDKGASAQSFIERMINFDKNLPNEKVLPKHSLLY-EYFTVYNELTKVKYVTEGMRKPAFLSGEQKKAIVDLLEKTNRKVIVKQL KEDYFKKIECFDSVEISGVEDRFNASLGTYHDLLKIIKDKDFLDNEENEDILEDI-VLILTLFEDREMIEERLKTYAHLFDDKVMKQLKRRRYTG WGRLSRKLINGIRDKQSGKTILDFLKSDGFANRNFMQLIHDDSLIFKEDIQKAQVSGQGD-SLHEHIANLAGSPAIKKGILQTVKVVDELVKVMG RHKPENIVIEMARENQTTQKGQKNSRERMKRIEEGIKELGSQILKEHPVENTQLQNEKLY-LYYLQNGRDMYVDQELDINRLSDYDVDHIVPQSF LKDDSIDNKVLIRSDKNRGKSDNVPSEEVVKKMKNYWRQLLNAKLITQRKEDNLIKAERG-GLSELDKAGFIKRQLVETRQIIKHVAQILDSRMN TKYDENDKLIREVKVITLKSKLVSDERKDFQFYKVREINNYHHAHDAYLNAVVGIALIK-KYPKLESEFVYGDYKVYDVRKMIAKSEQEIGKATA KYFFYSNIMNFFKTEITLANGEIRKRPLIETNGETGEIVWDKGRDFA-TVRKVLSMPQVNIVKKTEVQTGGFSKESILPKRNSDKLIARKKDWDP KKYGGFDSPIVAYSVLVVAKVEKGKSKKLKSVKELLGITIMERSSFEKNPIDFLEA-KGYKEVKKDLIIKLPKYSLFELENGRKRMLASAGELQK GNELALPSKYVNFLYLASHYEKLKGSPEDNEQKQLFVEQHKHYLDEIIEQISEFSKR-VILADANLDKVLSAYNKHRDKPIREQAENIIHLFILT NLGAPAAFKYFDTTIDRKRYISTKEVLDATLIHQSITGLYETRIDLSQLGGDGGGSAAAKRSWSMAF | 193 |
| Amino acid sequence for Cas9 with NLS9 | MDKKYSIGLDIGINSVGWAVITDEYKVPSKKFKVLGNIDRHSIKKNLIGALLFDSGETAE-ATRLKRTARRRYTRRKNRICYLQEIFSNEMAKVD DSFEHRLEESELVEEDKKHERHPIEGNIVDEVAYHEKYPTIYHLRKKLVD-STDKADLRLIYLALAHMIKERGHFLIEGDLNPDNSDVDKLFIQL VQTYNQLFEENPINASGVDAKAILSARLSKSRRLENLIAQLPGEKKNGLEGNLIA-LSLGLIPNEKSNFDLAEDAKLQLSKDTYDDDLDNLLAQI GDQYADLFLAAKNLSDAILLSDILRVNTEITKAPLSASMIKRYDEHHQDLILLKA-LVRQQLPEKYKEIFFDQSKNGYAGYIDGGASQEEFYKFI KPILEKMDGTEELLVKLNREDLLRKQRTFDNGSIPHQIHLGELHAILRRQEDFYPFLKDN-REKIEKILTFRIPYYVGPLARGNSRFAWMTRKSE ETITPWNFEEVVDKGASAQSFIERMINFDKNLPNEKVLPKHSLLY-EYFTVYNELTKVKYVTEGMRKPAFLSGEQKKAIVDLLEKTNRKVIVKQL KEDYFKKIECFDSVEISGVEDRFNASLGTYHDLLKIIKDKDFLDNEENEDILEDI-VLILTLFEDREMIEERLKTYAHLFDDKVMKQLKRRRYTG WGRLSRKLINGIRDKQSGKTILDFLKSDGFANRNFMQLIHDDSLIFKEDIQKAQVSGQGD-SLHEHIANLAGSPAIKKGILQTVKVVDELVKVMG RHKPENIVIEMARENQTTQKGQKNSRERMKRIEEGIKELGSQILKEHPVENTQLQNEKLY-LYYLQNGRDMYVDQELDINRLSDYDVDHIVPQSF LKDDSIDNKVLIRSDKNRGKSDNVPSEEVVKKMKNYWRQLLNAKLITQRKEDNLIKAERG-GLSELDKAGFIKRQLVETRQIIKHVAQILDSRMN TKYDENDKLIREVKVITLKSKLVSDERKDFQFYKVREINNYHHAHDAYLNAVVGIALIK-KYPKLESEFVYGDYKVYDVRKMIAKSEQEIGKATA KYFFYSNIMNFFKTEITLANGEIRKRPLIETNGETGEIVWDKGRDFA-TVRKVLSMPQVNIVKKTEVQTGGFSKESILPKRNSDKLIARKKDWDP KKYGGFDSPIVAYSVLVVAKVEKGKSKKLKSVKELLGITIMERSSFEKNPIDFLEA-KGYKEVKKDLIIKLPKYSLFELENGRKRMLASAGELQK GNELALPSKYVNFLYLASHYEKLKGSPEDNEQKQLFVEQHKHYLDEIIEQISEFSKR-VILADANLDKVLSAYNKHRDKPIREQAENIIHLFILT NLGAPAAFKYFDTTIDRKRYISTKEVLDATLIHQSITGLYETRIDLSQLGGDGGGSAAAKRKYFAA | 194 |
| Amino | MDKKYSIGLDIGINSVGWAVITDEYKVPSKKFKVLGNIDRHSIKKNLIGALLFDSGETAE-ATRLKRTARRRYTRRKNRICYLQEIFSNEMAKVD | 195 |

Sequence Table

The following sequence table provides a listing of sequences disclosed herein. It is understood that if a DNA sequence (comprising Ts) is referenced with respect to an RNA, then Ts should be replaced with Us (which may be modified or unmodified depending on the context), and vice versa.

| Description | Sequence | SEQ ID No. |
|---|---|---|
| acid sequence for Cas9 with NLS10 | DSFEHRLEESELVEEDKKHERHPIEGNIVDEVAYHEKYPTIYHLRKKLVD-STDKADLRLIYLALAHMIKERGHFLIEGDLNPDNSDVDKLFIQL VQTYNQLFEENPINASGVDAKAILSARLSKSRRLENLIAQLPGEKKNGLEGNLIA-LSLGLIPNEKSNFDLAEDAKLQLSKDTYDDDLDNLLAQI GDQYADLFLAAKNLSDAILLSDILRVNTEITKAPLSASMIKRYDEHHQDLILLKA-LVRQQLPEKYKEIFFDQSKNGYAGYIDGGASQEEFYKFI KPILEKMDGTEELLVKLNREDLLRKQRTFDNGSIPHQIHLGELHAILRRQEDFYPFLKDN-REKIEKILTFRIPYYVGPLARGNSRFAWMTRKSE ETITPWNFEEVVDKGASAQSFIERMINFDKNLPNEKVLPKHSLLY-EYFTVYNELTKVKYVTEGMRKPAFLSGEQKKAIVDLLEKTNRKVIVQL KEDYFKKIECFDSVEISGVEDRFNASLGTYHDLLKIIKDKDFLDNEENEDILEDI-VLILTLFEDREMIEERLKTYAHLFDDKVMKQLKRRRYTG WGRLSRKLINGIRDKQSGKTILDFLKSDGFANRNFMQLIHDDSLIFKEDIQKAQVSGQGD-SLHEHIANLAGSPAIKKGILQTVKVVDELVKVMG RHKPENIVIEMARENQTTKGQKNSRERMKRIEEGIKELGSQILKEHPVENTQLQNEKLY-LYYLQNGRDMYVDQELDINRLSDYDVDHIVPQSF LKDDSIDNKVLIRSDKNRGKSDNVPSEEVVKKMKNYWRQLLNAKLITQRKEDNLIKAERG-GLSELDKAGFIKRQLVETRQIIKHVAQILDSRMN TKYDENDKLIREVKVITLKSKLVSDERKDFQFYKVREINNYHHAHDAYLNAVVGIALIK-KYPKLESEFVYGDYKVYDVRKMIAKSEQEIGKATA KYFFYSNIMNFFKTEITLANGEIRKRPLIETNGETGEIVWDKGRDFA-TVRKVLSMPQVNIVKKTEVQTGGFSKESILPKRNSDKLIARKKDWDP KKYGGFDSPIVAYSVLVVAKVEKGKSKKLKSVKELLGITIMERSSFEKNPIDFLEA-KGYKEVKKDLIIKLPKYSLFELENGRKRMLASAGELQK GNELALPSKYVNFLYLASHYEKLKGSPEDNEQKQLFVEQHKYLDEIIEQISEFSKR-VILADANLDKVLSAYNKHRDKPIREQAENIIHLFILT NLGAPAAFKYFDTTIDRKRYTSTKEVLDATLIHQSITGLYETRIDLSQLGGDGGGSRAAKRKAFAA | |
| Amino acid sequence for Cas9 with NLS11 | MDKKYSIGLDIGINSVGWAVITDEYKVPSKKFKVLGNIDRHSIKKNLIGALLFDSGETAE-ATRLKRTARRRYTRRKNRICYLQEIFSNEMAKVD DSFEHRLEESELVEEDKKHERHPIEGNIVDEVAYHEKYPTIYHLRKKLVD-STDKADLRLIYLALAHMIKERGHFLIEGDLNPDNSDVDKLFIQL VQTYNQLFEENPINASGVDAKAILSARLSKSRRLENLIAQLPGEKKNGLEGNLIA-LSLGLIPNEKSNFDLAEDAKLQLSKDTYDDDLDNLLAQI GDQYADLFLAAKNLSDAILLSDILRVNTEITKAPLSASMIKRYDEHHQDLILLKA-LVRQQLPEKYKEIFFDQSKNGYAGYIDGGASQEEFYKFI KPILEKMDGTEELLVKLNREDLLRKQRTFDNGSIPHQIHLGELHAILRRQEDFYPFLKDN-REKIEKILTFRIPYYVGPLARGNSRFAWMTRKSE ETITPWNFEEVVDKGASAQSFIERMINFDKNLPNEKVLPKHSLLY-EYFTVYNELTKVKYVTEGMRKPAFLSGEQKKAIVDLLEKTNRKVIVQL KEDYFKKIECFDSVEISGVEDRFNASLGTYHDLLKIIKDKDFLDNEENEDILEDI-VLILTLFEDREMIEERLKTYAHLFDDKVMKQLKRRRYTG WGRLSRKLINGIRDKQSGKTILDFLKSDGFANRNFMQLIHDDSLIFKEDIQKAQVSGQGD-SLHEHIANLAGSPAIKKGILQTVKVVDELVKVMG RHKPENIVIEMARENQTTKGQKNSRERMKRIEEGIKELGSQILKEHPVENTQLQNEKLY-LYYLQNGRDMYVDQELDINRLSDYDVDHIVPQSF LKDDSIDNKVLIRSDKNRGKSDNVPSEEVVKKMKNYWRQLLNAKLITQRKEDNLIKAERG-GLSELDKAGFIKRQLVETRQIIKHVAQILDSRMN TKYDENDKLIREVKVITLKSKLVSDERKDFQFYKVREINNYHHAHDAYLNAVVGIALIK-KYPKLESEFVYGDYKVYDVRKMIAKSEQEIGKATA KYFFYSNIMNFFKTEITLANGEIRKRPLIETNGETGEIVWDKGRDFA-TVRKVLSMPQVNIVKKTEVQTGGFSKESILPKRNSDKLIARKKDWDP KKYGGFDSPIVAYSVLVVAKVEKGKSKKLKSVKELLGITIMERSSFEKNPIDFLEA-KGYKEVKKDLIIKLPKYSLFELENGRKRMLASAGELQK GNELALPSKYVNFLYLASHYEKLKGSPEDNEQKQLFVEQHKYLDEIIEQISEFSKR-VILADANLDKVLSAYNKHRDKPIREQAENIIHLFILT NLGAPAAFKYFDTTIDRKRYTSTKEVLDATLIHQSITGLYETRIDLSQLGGDGGGSRAAKRKYFAV | 196 |
| G506 guide RNA targeting TTR | mA*mU*mA*CCAGUCCAGCGAGGCAGGUUUUAGAmCmCmUmAmGmAmAmUmAmGmCAAGUUAAAAUAAGGCUAGUCC GUUAUCAmAmCmCmUmUmGmAmAmAmAmGmUmGmCmAmCmCmGmAmGmUmCmGmGmUmGmCmU*mU*mU*mU | 197 |
| G510 guide RNA targeting TTR | mA*mC*mU*UGUCUUCUCUAUACCCAGUUUUAGAmCmCmUmAmGmAmAmUmAmGmCAAGUUAAAAUAAGGCUAGUCC GUUAUCAmAmCmCmUmUmGmAmAmAmAmGmUmGmCmAmCmCmGmAmGmUmCmGmGmUmGmCmU*mU*mU*mU | 198 |

* = PS linkage; 'm' = 2'-O-Me nucleotide

SEQUENCE LISTING (198 sequences)

SEQ ID NO: 1 - DNA, 4140 bp, Artificial Sequence
  Synthetic: Cas9 DNA coding sequence 2
atggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcccgaagaagaagagaaaggtctag

SEQ ID NO: 2 - DNA, 4143 bp, Artificial Sequence
  Synthetic: Cas9 DNA coding sequence 1
atggataagaagtactcaatcgggctggatatcggaactaattccgtgggttgggcagtgatcacggatgaatacaaagtgccgtccaagaagttcaaggtcctggggaacaccgatagacacagcatcaagaaaaatctcatcggagccctgctgtttgactccggcgaaaccgcagaagcgacccggctcaaacgtaccgcgaggcgacgctacacccggcggaagaatcgcatctgctatctgcaagagatcttttcgaacgaaatggcaaaggtcgacgacagcttcttccaccgcctggaagaatctttcctggtggaggaggacaagaagcatgaacggcatcctatctttggaaacatcgtcgacgaagtggcgtaccacgaaaagtacccgaccatctaccatctgcggaagaagttggttgactcaactgacaaggccgacctcagattgatctacttggccctcgcccatatgatcaaattccgcggacacttcctgatcgaaggcgatctgaaccctgataactccgacgtggataagcttttcattcaactggtgcagacctacaaccaactgttcgaagaaaacccaatcaatgctagcggcgtcgatgccaaggccatcctgtccgcccggctgtcgaagtcgcggcgcctcgaaaacctgatcgcacagctgccgggagagaaaaagaacggacttttcggcaacttgatcgctctctcactgggactcactcccaatttcaagtccaattttgacctggccgaggacgcgaagctgcaactctcaaaggacacctacgacgacgacttggacaatttgctggcacaaattggcgatcagtacgcggatctgttccttgccgctaagaacctttcggacgcaatcttgctgtccgatatcctgcgcgtgaacaccgaaataaccaaagcgccgcttagcgcctcgatgattaagcggtacgacgagcatcaccaggatctcacgctgctcaaagcgctcgtgagacagcaactgcctgaaaagtacaaggagatcttcttcgaccagtccaagaatgggtacgcagggtacatcgatggaggcgctagccaggaagagttctataagttcatcaagccaatcctggaaaagatggacggaaccgaagaactgctggtcaagctgaacagggaggatctgctccggaaacagagaacctttgacaacggatccattccccaccagatccatctgggtgagctgcacgccatcttgcggcgccaggaggacttttacccattcctcaaggacaaccgggaaaagatcgagaaaattctgacgttccgcatcccgtattacgtgggcccactggcgcgcggcaattcgcgcttcgcgtggatgactagaaaatcagaggaaaccatcactccttggaatttcgaggaagttgtggataagggagcttcggcacaaagcttcatcgaacgaatgaccaacttcgacaagaatctcccaaacgagaaggtgcttcctaagcacagcctcctttacgaatacttcactgtctacaacgaactgactaaagtgaaatacgttactgaaggaatgaggaagccggcctttctgtccggagaacagaagaaagcaattgtcgatctgctgttcaagaccaaccgcaaggtgaccgtcaagcagcttaaagaggactacttcaagaagatcgagtgtttcgactcagtggaaatcagcggggtggaggacagattcaacgcttcgctgggaacctatcatgatctcctgaagatcatcaaggacaaggacttccttgacaacgaggagaacgaggacatcctggaagatatcgtcctgaccttgacccttttcgaggatcgcgagatgatcgaggagaggcttaagacctacgctcatctcttcgacgataaggtcatgaaacaactcaagcgccgccggtacactggttggggccgcctctcccgcaagctgatcaacggtattcgcgataaacagagcggtaaaactatcctggatttcctcaaatcggatggcttcgctaatcgtaacttcatgcaattgatccacgacgacagcctgacctttaaggaggacatccaaaaagcacaagtgtccggacagggagactcactccatgaacacatcgcgaatctggccggttcgccggcgattaagaagggaattctgcaaactgtgaaggtggtcgacgagctggtgaaggtcatgggacggcacaaaccggagaatatcgtgattgaaatggcccgagaaaaccagactacccagaagggccagaaaaactcccgcgaaaggatgaagcggatcgaagaaggaatcaaggagctgggcagccagatcctgaaagagcacccggtggaaaacacgcagctgcagaacgagaagctctacctgtactatttgcaaaatggacgggacatgtacgtggaccaagagctggacatcaatcggttgtctgattacgacgtggaccacatcgttccacagtcctttctgaaggatgactcgatcgataacaaggtgttgactcgcagcgacaagaacagagggaagtcagataatgtgccatcggaggaggtcgtgaagaagatgaagaattactggcggcagctcctgaatgcgaagctgattacccagagaaagtttgacaatctcactaaagccgagcgcggcggactctcagagctggataaggctggattcatcaaacggcagctggtcgagactcggcagattaccaagcacgtggcgcagatcttggactcccgcatgaacactaaatacgacgagaacgataagctcatccgggaagtgaaggtgattaccctgaaaagcaaacttgtgtcggactttcggaaggactttcagttttacaaagtgagagaaatcaacaactaccatcacgcgcatgacgcatacctcaacgctgtggtcggtaccgccctgatcaaaaagtaccctaaacttgaatcggagtttgtgtacggagactacaaggtctacgacgtgaggaagatgatagccaagtccgaacaggaaatcgggaaagcaactgcgaaatacttcttttactcaaacatcatgaactttttcaagactgaaattacgctggccaatggagaaatcaggaagaggccactgatcgaaactaacggagaaacgggcgaaatcgtgtgggacaagggcagggacttcgcaactgttcgcaaagtgctctctatgccgcaagtcaatattgtgaagaaaaccgaagtgcaaaccggcggattttcaaaggaatcgatcctcccaaagagaaatagcgacaagctcattgcacgcaagaaagactgggacccgaagaagtacggaggattcgattcgccgactgtcgcatactccgtcctcgtggtggccaaggtggagaagggaaagagcaaaaagctcaaatccgtcaaagagctgctggggattaccatcatggaacgatcctcgttcgagaagaacccgattgatttcctcgaggcgaagggttacaaggaggtgaagaaggatctgatcatcaaactccccaagtactcactgttcgaactggaaaatggtcggaagcgcatgctggcttcggccggagaactccaaaaaggaaatgagctggccttgcctagcaagtacgtcaacttcctctatcttgcttcgcactacgaaaaactcaaagggtcaccggaagataacgaacagaagcagcttttcgtggagcagcacaagcattatctggatgaaatcatcgaacaaatctccgagttttcaaagcgcgtgatcctcgccgacgccaacctcgacaaagtcctgtcggcctacaataagcatagagataagccgatcagagaacaggccgagaacattatccacttgttcaccctgactaacctgggagccccagccgccttcaagtacttcgatactactatcgatcgcaaaagatacacgtccaccaaggaagttctggacgcgaccctgatccaccaaagcatcactggactctacgaaactaggatcgatctgtcgcagctgggtggcgatggcggtggatctccgaaaaagaagagaaaggtgtaatga

SEQ ID NO: 3 - protein, 1379 aa, Artificial Sequence
  Synthetic: Cas9 amino acid sequence
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSPKKKRKV

SEQ ID NO: 4 - RNA, 4140 nt, Artificial Sequence
  Synthetic: Cas9 mRNA open reading frame (ORF) 2
auggacaagaaguacagcaucggacuggacaucggaacaaacagcgucggaugggcagucaucacagacgaauacaaggucccgagcaagaaguucaagguccugggaaacacagacagacacagcaucaagaagaaccugaucggagcacugcuguucgacagcggagaaacagcagaagcaacaagacugaagagaacagcaagaagaagauacacaagaagaaagaacagaaucugcuaccugcaggaaaucuucagcaacgaaauggcaaaggucgacgacagcuucuuccacagacuggaagaaagcuuccuggucgaagaagacaagaagcacgaaagacacccgaucuucggaaacaucgucgacgaagucgcauaccacgaaaaguacccgacaaucuaccaccugagaaagaagcuggucgacagcacagacaaggcagaccugagacugaucuaccuggcacuggcacacaugaucaaguucagaggacacuuccugaucgaaggagaccugaacccggacaacagcgacgucgacaagcuguucauccagcugguccagacauacaaccagcuguucgaagaaaacccgaucaacgcaagcggagucgacgcaaaggcaauccugagcgcaagacugagcaagagcagaagacuggaaaaccugaucgcacagcugccgggagaaaagaagaacggacuguucggaaaccugaucgcacugagccugggacugacaccgaacuucaagagcaacuucgaccuggcagaagacgcaaagcugcagcugagcaaggacacauacgacgacgaccuggacaaccugcuggcacagaucggagaccaguacgcagaccuguuccuggcagcaaagaaccugagcgacgcaauccugcugagcgacauccugagagucaacacagaaaucacaaaggcaccgcugagcgcaagcaugaucaagagauacgacgaacaccaccaggaccugacacugcugaaggcacuggucagacagcagcugccggaaaaguacaaggaaaucuucuucgaccagagcaagaacggauacgcaggauacaucgacggaggagcaagccaggaagaauucuacaaguucaucaagccgauccuggaaaagauggacggaacagaagaacugcuggucaagcugaacagagaagaccugcugagaaagcagagaacauucgacaacggaagcaucccgcaccagauccaccugggagaacugcacgcaauccugagaagacaggaagacuucuacccguuccugaaggacaacagagaaaagaucgaaaagauccugacauucagaaucccguacuacgucggaccgcuggcaagaggaaacagcagauucgcauggaugacaagaaagagcgaagaaacaaucacaccguggaacuucgaagaagucgucgacaagggagcaagcgcacagagcuucaucgaaagaaugacaaacuucgacaagaaccugccgaacgaaaagguccugccgaagcacagccugcuguacgaauacuucacagucuacaacgaacugacaaaggucaaguacgucacagaaggaaugagaaagccggcauuccugagcggagaacagaagaaggcaaucgucgaccugcuguucaagacaaacagaaaggucacagucaagcagcugaaggaagacuacuucaagaagaucgaaugcuucgacagcgucgaaaucagcggagucgaagacagauucaacgcaagccugggaacauaccacgaccugcugaagaucaucaaggacaaggacuuccuggacaacgaagaaaacgaagacauccuggaagacaucguccugacacugacacuguucgaagacagagaaaugaucgaagaaagacugaagacauacgcacaccuguucgacgacaaggucaugaagcagcugaagagaagaagauacacaggauggggaagacugagcagaaagcugaucaacggaaucagagacaagcagagcggaaagacaauccuggacuuccugaagagcgacggauucgcaaacagaaacuucaugcagcugauccacgacgacagccugacauucaaggaagacauccagaaggcacaggucagcggacagggagacagccugcacgaacacaucgcaaaccuggcaggaagcccggcaaucaagaagggaauccugcagacagucaaggucgucgacgaacuggucaaggucaugggaagacacaagccggaaaacaucgucaucgaaauggcaagagaaaaccagacaacacagaagggacagaagaacagcagagaaagaaugaagagaaucgaagaaggaaucaaggaacugggaagccagauccugaaggaacacccggucgaaaacacacagcugcagaacgaaaagcuguaccuguacuaccugcagaacggaagagacauguacgucgaccaggaacuggacaucaacagacugagcgacuacgacgucgaccacaucgucccgcagagcuuccugaaggacgacagcaucgacaacaagguccugacaagaagcgacaagaacagaggaaagagcgacaacgucccgagcgaagaagucgucaagaagaugaagaacuacuggagacagcugcugaacgcaaagcugaucacacagagaaaguucgacaaccugacaaaggcagagagaggaggacugagcgaacuggacaaggcaggauucaucaagagacagcuggucgaaacaagacagaucacaaagcacgucgcacagauccuggacagcagaaugaacacaaaguacgacgaaaacgacaagcugaucagagaagucaaggucaucacacugaagagcaagcuggucagcgacuucagaaaggacuuccaguucuacaaggucagagaaaucaacaacuaccaccacgcacacgacgcauaccugaacgcagucgucggaacagcacugaucaagaaguacccgaagcuggaaagcgaauucgucuacggagacuacaaggucuacgacgucagaaagaugaucgcaaagagcgaacaggaaaucggaaaggcaacagcaaaguacuucuucuacagcaacaucaugaacuucuucaagacagaaaucacacuggcaaacggagaaaucagaaagagaccgcugaucgaaacaaacggagaaacaggagaaaucgucugggacaagggaagagacuucgcaacagucagaaagguccugagcaugccgcaggucaacaucgucaagaagacagaaguccagacaggaggauucagcaaggaaagcauccugccgaagagaaacagcgacaagcugaucgcaagaaagaaggacugggacccgaagaaguacggaggauucgacagcccgacagucgcauacagcguccuggucgucgcaaaggucgaaaagggaaagagcaagaagcugaagagcgucaaggaacugcugggaaucacaaucauggaaagaagcagcuucgaaaagaacccgaucgacuuccuggaagcaaagggauacaaggaagucaagaaggaccugaucaucaagcugccgaaguacagccuguucgaacuggaaaacggaagaaagagaaugcuggcaagcgcaggagaacugcagaagggaaacgaacuggcacugccgagcaaguacgucaacuuccuguaccuggcaagccacuacgaaaagcugaagggaagcccggaagacaacgaacagaagcagcuguucgucgaacagcacaagcacuaccuggacgaaaucaucgaacagaucagcgaauucagcaagagagucauccuggcagacgcaaaccuggacaagguccugagcgcauacaacaagcacagagacaagccgaucagagaacaggcagaaaacaucauccaccuguucacacugacaaaccugggagcaccggcagcauucaaguacuucgacacaacaaucgacagaaagagauacacaagcacaaaggaaguccuggacgcaacacugauccaccagagcaucacaggacuguacgaaacaagaaucgaccugagccagcugggaggagacggaggaggaagcccgaagaagaagagaaaggucuag

SEQ ID NO: 5 - RNA, 4143 nt, Artificial Sequence
  Synthetic: Cas9 mRNA ORF 1
auggauaagaaguacucaaucgggcuggauaucggaacuaauuccguggguugggcagugaucacggaugaauacaaagugccguccaagaaguucaagguccuggggaacaccgauagacacagcaucaagaaaaaucucaucggagcccugcuguuugacuccggcgaaaccgcagaagcgacccggcucaaacguaccgcgaggcgacgcuacacccggcggaagaaucgcaucugcuaucugcaagagaucuuuucgaacgaaauggcaaaggucgacgacagcuucuuccaccgccuggaagaaucuuuccugguggaggaggacaagaagcaugaacggcauccuaucuuuggaaacaucgucgacgaaguggcguaccacgaaaaguacccgaccaucuaccaucugcggaagaaguugguugacucaacugacaaggccgaccucagauugaucuacuuggcccucgcccauaugaucaaauuccgcggacacuuccugaucgaaggcgaucugaacccugauaacuccgacguggauaagcuuuucauucaacuggugcagaccuacaaccaacuguucgaagaaaacccaaucaaugcuagcggcgucgaugccaaggccauccuguccgcccggcugucgaagucgcggcgccucgaaaaccugaucgcacagcugccgggagagaaaaagaacggacuuuucggcaacuugaucgcucucucacugggacucacucccaauuucaaguccaauuuugaccuggccgaggacgcgaagcugcaacucucaaaggacaccuacgacgacgacuuggacaauuugcuggcacaaauuggcgaucaguacgcggaucuguuccuugccgcuaagaaccuuucggacgcaaucuugcuguccgauauccugcgcgugaacaccgaaauaaccaaagcgccgcuuagcgccucgaugauuaagcgguacgacgagcaucaccaggaucucacgcugcucaaagcgcucgugagacagcaacugccugaaaaguacaaggagaucuucuucgaccaguccaagaauggguacgcaggguacaucgauggaggcgcuagccaggaagaguucuauaaguucaucaagccaauccuggaaaagauggacggaaccgaagaacugcuggucaagcugaacagggaggaucugcuccggaaacagagaaccuuugacaacggauccauuccccaccagauccaucugggugagcugcacgccaucuugcggcgccaggaggacuuuuacccauuccucaaggacaaccgggaaaagaucgagaaaauucugacguuccgcaucccguauuacgugggcccacuggcgcgcggcaauucgcgcuucgcguggaugacuagaaaaucagaggaaaccaucacuccuuggaauuucgaggaaguuguggauaagggagcuucggcacaaagcuucaucgaacgaaugaccaacuucgacaagaaucucccaaacgagaaggugcuuccuaagcacagccuccuuuacgaauacuucacugucuacaacgaacugacuaaagugaaauacguuacugaaggaaugaggaagccggccuuucuguccggagaacagaagaaagcaauugucgaucugcuguucaagaccaaccgcaaggugaccgucaagcagcuuaaagaggacuacuucaagaagaucgaguguuucgacucaguggaaaucagcgggguggaggacagauucaacgcuucgcugggaaccuaucaugaucuccugaagaucaucaaggacaaggacuuccuugacaacgaggagaacgaggacauccuggaagauaucguccugaccuugacccuuuucgaggaucgcgagaugaucgaggagaggcuuaagaccuacgcucaucucuucgacgauaaggucaugaaacaacucaagcgccgccgguacacugguuggggccgccucucccgcaagcugaucaacgguauucgcgauaaacagagcgguaaaacuauccuggauuuccucaaaucggauggcuucgcuaaucguaacuucaugcaauugauccacgacgacagccugaccuuuaaggaggacauccaaaaagcacaaguguccggacagggagacucacuccaugaacacaucgcgaaucuggccgguucgccggcgauuaagaagggaauucugcaaacugugaagguggucgacgagcuggugaaggucaugggacggcacaaaccggagaauaucgugauugaaauggcccgagaaaaccagacuacccagaagggccagaaaaacucccgcgaaaggaugaagcggaucgaagaaggaaucaaggagcugggcagccagauccugaaagagcacccgguggaaaacacgcagcugcagaacgagaagcucuaccuguacuauuugcaaaauggacgggacauguacguggaccaagagcuggacaucaaucgguugucugauuacgacguggaccacaucguuccacaguccuuucugaaggaugacucgaucgauaacaagguguugacucgcagcgacaagaacagagggaagucagauaaugugccaucggaggaggucgugaagaagaugaagaauuacuggcggcagcuccugaaugcgaagcugauuacccagagaaaguuugacaaucucacuaaagccgagcgcggcggacucucagagcuggauaaggcuggauucaucaaacggcagcuggucgagacucggcagauuaccaagcacguggcgcagaucuuggacucccgcaugaacacuaaauacgacgagaacgauaagcucauccgggaagugaaggugauuacccugaaaagcaaacuugugucggacuuucggaaggacuuucaguuuuacaaagugagagaaaucaacaacuaccaucacgcgcaugacgcauaccucaacgcuguggucgguaccgcccugaucaaaaaguacccuaaacuugaaucggaguuuguguacggagacuacaaggucuacgacgugaggaagaugauagccaaguccgaacaggaaaucgggaaagcaacugcgaaauacuucuuuuacucaaacaucaugaacuuuuucaagacugaaauuacgcuggccaauggagaaaucaggaagaggccacugaucgaaacuaacggagaaacgggcgaaaucgugugggacaagggcagggacuucgcaacuguucgcaaagugcucucuaugccgcaagucaauauugugaagaaaaccgaagugcaaaccggcggauuuucaaaggaaucgauccucccaaagagaaauagcgacaagcucauugcacgcaagaaagacugggacccgaagaaguacggaggauucgauucgccgacugucgcauacuccguccucgugguggccaagguggagaagggaaagagcaaaaagcucaaauccgucaaagagcugcuggggauuaccaucauggaacgauccucguucgagaagaacccgauugauuuccucgaggcgaaggguuacaaggaggugaagaaggaucugaucaucaaacuccccaaguacucacuguucgaacuggaaaauggucggaagcgcaugcuggcuucggccggagaacuccaaaaaggaaaugagcuggccuugccuagcaaguacgucaacuuccucuaucuugcuucgcacuacgaaaaacucaaagggucaccggaagauaacgaacagaagcagcuuuucguggagcagcacaagcauuaucuggaugaaaucaucgaacaaaucuccgaguuuucaaagcgcgugauccucgccgacgccaaccucgacaaaguccugucggccuacaauaagcauagagauaagccgaucagagaacaggccgagaacauuauccacuuguucacccugacuaaccugggagccccagccgccuucaaguacuucgauacuacuaucgaucgcaaaagauacacguccaccaaggaaguucuggacgcgacccugauccaccaaagcaucacuggacucuacgaaacuaggaucgaucugucgcagcuggguggcgauggcgguggaucuccgaaaaagaagagaaagguguaauga

SEQ ID NO: 6 - protein, 1379 aa, Artificial Sequence
  Synthetic: Cas9 nickase (D10A) amino acid sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSPKKKRKV

SEQ ID NO: 7 - RNA, 4140 nt, Artificial Sequence
  Synthetic: Cas9 nickase (D10A) mRNA ORF
auggacaagaaguacagcaucggacuggcaaucggaacaaacagcgucggaugggcagucaucacagacgaauacaaggucccgagcaagaaguucaagguccugggaaacacagacagacacagcaucaagaagaaccugaucggagcacugcuguucgacagcggagaaacagcagaagcaacaagacugaagagaacagcaagaagaagauacacaagaagaaagaacagaaucugcuaccugcaggaaaucuucagcaacgaaauggcaaaggucgacgacagcuucuuccacagacuggaagaaagcuuccuggucgaagaagacaagaagcacgaaagacacccgaucuucggaaacaucgucgacgaagucgcauaccacgaaaaguacccgacaaucuaccaccugagaaagaagcuggucgacagcacagacaaggcagaccugagacugaucuaccuggcacuggcacacaugaucaaguucagaggacacuuccugaucgaaggagaccugaacccggacaacagcgacgucgacaagcuguucauccagcugguccagacauacaaccagcuguucgaagaaaacccgaucaacgcaagcggagucgacgcaaaggcaauccugagcgcaagacugagcaagagcagaagacuggaaaaccugaucgcacagcugccgggagaaaagaagaacggacuguucggaaaccugaucgcacugagccugggacugacaccgaacuucaagagcaacuucgaccuggcagaagacgcaaagcugcagcugagcaaggacacauacgacgacgaccuggacaaccugcuggcacagaucggagaccaguacgcagaccuguuccuggcagcaaagaaccugagcgacgcaauccugcugagcgacauccugagagucaacacagaaaucacaaaggcaccgcugagcgcaagcaugaucaagagauacgacgaacaccaccaggaccugacacugcugaaggcacuggucagacagcagcugccggaaaaguacaaggaaaucuucuucgaccagagcaagaacggauacgcaggauacaucgacggaggagcaagccaggaagaauucuacaaguucaucaagccgauccuggaaaagauggacggaacagaagaacugcuggucaagcugaacagagaagaccugcugagaaagcagagaacauucgacaacggaagcaucccgcaccagauccaccugggagaacugcacgcaauccugagaagacaggaagacuucuacccguuccugaaggacaacagagaaaagaucgaaaagauccugacauucagaaucccguacuacgucggaccgcuggcaagaggaaacagcagauucgcauggaugacaagaaagagcgaagaaacaaucacaccguggaacuucgaagaagucgucgacaagggagcaagcgcacagagcuucaucgaaagaaugacaaacuucgacaagaaccugccgaacgaaaagguccugccgaagcacagccugcuguacgaauacuucacagucuacaacgaacugacaaaggucaaguacgucacagaaggaaugagaaagccggcauuccugagcggagaacagaagaaggcaaucgucgaccugcuguucaagacaaacagaaaggucacagucaagcagcugaaggaagacuacuucaagaagaucgaaugcuucgacagcgucgaaaucagcggagucgaagacagauucaacgcaagccugggaacauaccacgaccugcugaagaucaucaaggacaaggacuuccuggacaacgaagaaaacgaagacauccuggaagacaucguccugacacugacacuguucgaagacagagaaaugaucgaagaaagacugaagacauacgcacaccuguucgacgacaaggucaugaagcagcugaagagaagaagauacacaggauggggaagacugagcagaaagcugaucaacggaaucagagacaagcagagcggaaagacaauccuggacuuccugaagagcgacggauucgcaaacagaaacuucaugcagcugauccacgacgacagccugacauucaaggaagacauccagaaggcacaggucagcggacagggagacagccugcacgaacacaucgcaaaccuggcaggaagcccggcaaucaagaagggaauccugcagacagucaaggucgucgacgaacuggucaaggucaugggaagacacaagccggaaaacaucgucaucgaaauggcaagagaaaaccagacaacacagaagggacagaagaacagcagagaaagaaugaagagaaucgaagaaggaaucaaggaacugggaagccagauccugaaggaacacccggucgaaaacacacagcugcagaacgaaaagcuguaccuguacuaccugcagaacggaagagacauguacgucgaccaggaacuggacaucaacagacugagcgacuacgacgucgaccacaucgucccgcagagcuuccugaaggacgacagcaucgacaacaagguccugacaagaagcgacaagaacagaggaaagagcgacaacgucccgagcgaagaagucgucaagaagaugaagaacuacuggagacagcugcugaacgcaaagcugaucacacagagaaaguucgacaaccugacaaaggcagagagaggaggacugagcgaacuggacaaggcaggauucaucaagagacagcuggucgaaacaagacagaucacaaagcacgucgcacagauccuggacagcagaaugaacacaaaguacgacgaaaacgacaagcugaucagagaagucaaggucaucacacugaagagcaagcuggucagcgacuucagaaaggacuuccaguucuacaaggucagagaaaucaacaacuaccaccacgcacacgacgcauaccugaacgcagucgucggaacagcacugaucaagaaguacccgaagcuggaaagcgaauucgucuacggagacuacaaggucuacgacgucagaaagaugaucgcaaagagcgaacaggaaaucggaaaggcaacagcaaaguacuucuucuacagcaacaucaugaacuucuucaagacagaaaucacacuggcaaacggagaaaucagaaagagaccgcugaucgaaacaaacggagaaacaggagaaaucgucugggacaagggaagagacuucgcaacagucagaaagguccugagcaugccgcaggucaacaucgucaagaagacagaaguccagacaggaggauucagcaaggaaagcauccugccgaagagaaacagcgacaagcugaucgcaagaaagaaggacugggacccgaagaaguacggaggauucgacagcccgacagucgcauacagcguccuggucgucgcaaaggucgaaaagggaaagagcaagaagcugaagagcgucaaggaacugcugggaaucacaaucauggaaagaagcagcuucgaaaagaacccgaucgacuuccuggaagcaaagggauacaaggaagucaagaaggaccugaucaucaagcugccgaaguacagccuguucgaacuggaaaacggaagaaagagaaugcuggcaagcgcaggagaacugcagaagggaaacgaacuggcacugccgagcaaguacgucaacuuccuguaccuggcaagccacuacgaaaagcugaagggaagcccggaagacaacgaacagaagcagcuguucgucgaacagcacaagcacuaccuggacgaaaucaucgaacagaucagcgaauucagcaagagagucauccuggcagacgcaaaccuggacaagguccugagcgcauacaacaagcacagagacaagccgaucagagaacaggcagaaaacaucauccaccuguucacacugacaaaccugggagcaccggcagcauucaaguacuucgacacaacaaucgacagaaagagauacacaagcacaaaggaaguccuggacgcaacacugauccaccagagcaucacaggacuguacgaaacaagaaucgaccugagccagcugggaggagacggaggaggaagcccgaagaagaagagaaaggucuag

SEQ ID NO: 8 - protein, 1379 aa, Artificial Sequence
  Synthetic: dCas9 (D10A H840A) amino acid sequence
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSPKKKRKV

SEQ ID NO: 9 - RNA, 4140 nt, Artificial Sequence
  Synthetic: dCas9 (D10A H840A) mRNA ORF
auggacaagaaguacagcaucggacuggcaaucggaacaaacagcgucggaugggcagucaucacagacgaauacaaggucccgagcaagaaguucaagguccugggaaacacagacagacacagcaucaagaagaaccugaucggagcacugcuguucgacagcggagaaacagcagaagcaacaagacugaagagaacagcaagaagaagauacacaagaagaaagaacagaaucugcuaccugcaggaaaucuucagcaacgaaauggcaaaggucgacgacagcuucuuccacagacuggaagaaagcuuccuggucgaagaagacaagaagcacgaaagacacccgaucuucggaaacaucgucgacgaagucgcauaccacgaaaaguacccgacaaucuaccaccugagaaagaagcuggucgacagcacagacaaggcagaccugagacugaucuaccuggcacuggcacacaugaucaaguucagaggacacuuccugaucgaaggagaccugaacccggacaacagcgacgucgacaagcuguucauccagcugguccagacauacaaccagcuguucgaagaaaacccgaucaacgcaagcggagucgacgcaaaggcaauccugagcgcaagacugagcaagagcagaagacuggaaaaccugaucgcacagcugccgggagaaaagaagaacggacuguucggaaaccugaucgcacugagccugggacugacaccgaacuucaagagcaacuucgaccuggcagaagacgcaaagcugcagcugagcaaggacacauacgacgacgaccuggacaaccugcuggcacagaucggagaccaguacgcagaccuguuccuggcagcaaagaaccugagcgacgcaauccugcugagcgacauccugagagucaacacagaaaucacaaaggcaccgcugagcgcaagcaugaucaagagauacgacgaacaccaccaggaccugacacugcugaaggcacuggucagacagcagcugccggaaaaguacaaggaaaucuucuucgaccagagcaagaacggauacgcaggauacaucgacggaggagcaagccaggaagaauucuacaaguucaucaagccgauccuggaaaagauggacggaacagaagaacugcuggucaagcugaacagagaagaccugcugagaaagcagagaacauucgacaacggaagcaucccgcaccagauccaccugggagaacugcacgcaauccugagaagacaggaagacuucuacccguuccugaaggacaacagagaaaagaucgaaaagauccugacauucagaaucccguacuacgucggaccgcuggcaagaggaaacagcagauucgcauggaugacaagaaagagcgaagaaacaaucacaccguggaacuucgaagaagucgucgacaagggagcaagcgcacagagcuucaucgaaagaaugacaaacuucgacaagaaccugccgaacgaaaagguccugccgaagcacagccugcuguacgaauacuucacagucuacaacgaacugacaaaggucaaguacgucacagaaggaaugagaaagccggcauuccugagcggagaacagaagaaggcaaucgucgaccugcuguucaagacaaacagaaaggucacagucaagcagcugaaggaagacuacuucaagaagaucgaaugcuucgacagcgucgaaaucagcggagucgaagacagauucaacgcaagccugggaacauaccacgaccugcugaagaucaucaaggacaaggacuuccuggacaacgaagaaaacgaagacauccuggaagacaucguccugacacugacacuguucgaagacagagaaaugaucgaagaaagacugaagacauacgcacaccuguucgacgacaaggucaugaagcagcugaagagaagaagauacacaggauggggaagacugagcagaaagcugaucaacggaaucagagacaagcagagcggaaagacaauccuggacuuccugaagagcgacggauucgcaaacagaaacuucaugcagcugauccacgacgacagccugacauucaaggaagacauccagaaggcacaggucagcggacagggagacagccugcacgaacacaucgcaaaccuggcaggaagcccggcaaucaagaagggaauccugcagacagucaaggucgucgacgaacuggucaaggucaugggaagacacaagccggaaaacaucgucaucgaaauggcaagagaaaaccagacaacacagaagggacagaagaacagcagagaaagaaugaagagaaucgaagaaggaaucaaggaacugggaagccagauccugaaggaacacccggucgaaaacacacagcugcagaacgaaaagcuguaccuguacuaccugcagaacggaagagacauguacgucgaccaggaacuggacaucaacagacugagcgacuacgacgucgacgcaaucgucccgcagagcuuccugaaggacgacagcaucgacaacaagguccugacaagaagcgacaagaacagaggaaagagcgacaacgucccgagcgaagaagucgucaagaagaugaagaacuacuggagacagcugcugaacgcaaagcugaucacacagagaaaguucgacaaccugacaaaggcagagagaggaggacugagcgaacuggacaaggcaggauucaucaagagacagcuggucgaaacaagacagaucacaaagcacgucgcacagauccuggacagcagaaugaacacaaaguacgacgaaaacgacaagcugaucagagaagucaaggucaucacacugaagagcaagcuggucagcgacuucagaaaggacuuccaguucuacaaggucagagaaaucaacaacuaccaccacgcacacgacgcauaccugaacgcagucgucggaacagcacugaucaagaaguacccgaagcuggaaagcgaauucgucuacggagacuacaaggucuacgacgucagaaagaugaucgcaaagagcgaacaggaaaucggaaaggcaacagcaaaguacuucuucuacagcaacaucaugaacuucuucaagacagaaaucacacuggcaaacggagaaaucagaaagagaccgcugaucgaaacaaacggagaaacaggagaaaucgucugggacaagggaagagacuucgcaacagucagaaagguccugagcaugccgcaggucaacaucgucaagaagacagaaguccagacaggaggauucagcaaggaaagcauccugccgaagagaaacagcgacaagcugaucgcaagaaagaaggacugggacccgaagaaguacggaggauucgacagcccgacagucgcauacagcguccuggucgucgcaaaggucgaaaagggaaagagcaagaagcugaagagcgucaaggaacugcugggaaucacaaucauggaaagaagcagcuucgaaaagaacccgaucgacuuccuggaagcaaagggauacaaggaagucaagaaggaccugaucaucaagcugccgaaguacagccuguucgaacuggaaaacggaagaaagagaaugcuggcaagcgcaggagaacugcagaagggaaacgaacuggcacugccgagcaaguacgucaacuuccuguaccuggcaagccacuacgaaaagcugaagggaagcccggaagacaacgaacagaagcagcuguucgucgaacagcacaagcacuaccuggacgaaaucaucgaacagaucagcgaauucagcaagagagucauccuggcagacgcaaaccuggacaagguccugagcgcauacaacaagcacagagacaagccgaucagagaacaggcagaaaacaucauccaccuguucacacugacaaaccugggagcaccggcagcauucaaguacuucgacacaacaaucgacagaaagagauacacaagcacaaaggaaguccuggacgcaacacugauccaccagagcaucacaggacuguacgaaacaagaaucgaccugagccagcugggaggagacggaggaggaagcccgaagaagaagagaaaggucuag

SEQ ID NO: 10 - RNA, 4134 nt, Artificial Sequence
  Synthetic: Cas9 bare coding sequence
gacaagaaguacagcaucggacuggacaucggaacaaacagcgucggaugggcagucaucacagacgaauacaaggucccgagcaagaaguucaagguccugggaaacacagacagacacagcaucaagaagaaccugaucggagcacugcuguucgacagcggagaaacagcagaagcaacaagacugaagagaacagcaagaagaagauacacaagaagaaagaacagaaucugcuaccugcaggaaaucuucagcaacgaaauggcaaaggucgacgacagcuucuuccacagacuggaagaaagcuuccuggucgaagaagacaagaagcacgaaagacacccgaucuucggaaacaucgucgacgaagucgcauaccacgaaaaguacccgacaaucuaccaccugagaaagaagcuggucgacagcacagacaaggcagaccugagacugaucuaccuggcacuggcacacaugaucaaguucagaggacacuuccugaucgaaggagaccugaacccggacaacagcgacgucgacaagcuguucauccagcugguccagacauacaaccagcuguucgaagaaaacccgaucaacgcaagcggagucgacgcaaaggcaauccugagcgcaagacugagcaagagcagaagacuggaaaaccugaucgcacagcugccgggagaaaagaagaacggacuguucggaaaccugaucgcacugagccugggacugacaccgaacuucaagagcaacuucgaccuggcagaagacgcaaagcugcagcugagcaaggacacauacgacgacgaccuggacaaccugcuggcacagaucggagaccaguacgcagaccuguuccuggcagcaaagaaccugagcgacgcaauccugcugagcgacauccugagagucaacacagaaaucacaaaggcaccgcugagcgcaagcaugaucaagagauacgacgaacaccaccaggaccugacacugcugaaggcacuggucagacagcagcugccggaaaaguacaaggaaaucuucuucgaccagagcaagaacggauacgcaggauacaucgacggaggagcaagccaggaagaauucuacaaguucaucaagccgauccuggaaaagauggacggaacagaagaacugcuggucaagcugaacagagaagaccugcugagaaagcagagaacauucgacaacggaagcaucccgcaccagauccaccugggagaacugcacgcaauccugagaagacaggaagacuucuacccguuccugaaggacaacagagaaaagaucgaaaagauccugacauucagaaucccguacuacgucggaccgcuggcaagaggaaacagcagauucgcauggaugacaagaaagagcgaagaaacaaucacaccguggaacuucgaagaagucgucgacaagggagcaagcgcacagagcuucaucgaaagaaugacaaacuucgacaagaaccugccgaacgaaaagguccugccgaagcacagccugcuguacgaauacuucacagucuacaacgaacugacaaaggucaaguacgucacagaaggaaugagaaagccggcauuccugagcggagaacagaagaaggcaaucgucgaccugcuguucaagacaaacagaaaggucacagucaagcagcugaaggaagacuacuucaagaagaucgaaugcuucgacagcgucgaaaucagcggagucgaagacagauucaacgcaagccugggaacauaccacgaccugcugaagaucaucaaggacaaggacuuccuggacaacgaagaaaacgaagacauccuggaagacaucguccugacacugacacuguucgaagacagagaaaugaucgaagaaagacugaagacauacgcacaccuguucgacgacaaggucaugaagcagcugaagagaagaagauacacaggauggggaagacugagcagaaagcugaucaacggaaucagagacaagcagagcggaaagacaauccuggacuuccugaagagcgacggauucgcaaacagaaacuucaugcagcugauccacgacgacagccugacauucaaggaagacauccagaaggcacaggucagcggacagggagacagccugcacgaacacaucgcaaaccuggcaggaagcccggcaaucaagaagggaauccugcagacagucaaggucgucgacgaacuggucaaggucaugggaagacacaagccggaaaacaucgucaucgaaauggcaagagaaaaccagacaacacagaagggacagaagaacagcagagaaagaaugaagagaaucgaagaaggaaucaaggaacugggaagccagauccugaaggaacacccggucgaaaacacacagcugcagaacgaaaagcuguaccuguacuaccugcagaacggaagagacauguacgucgaccaggaacuggacaucaacagacugagcgacuacgacgucgaccacaucgucccgcagagcuuccugaaggacgacagcaucgacaacaagguccugacaagaagcgacaagaacagaggaaagagcgacaacgucccgagcgaagaagucgucaagaagaugaagaacuacuggagacagcugcugaacgcaaagcugaucacacagagaaaguucgacaaccugacaaaggcagagagaggaggacugagcgaacuggacaaggcaggauucaucaagagacagcuggucgaaacaagacagaucacaaagcacgucgcacagauccuggacagcagaaugaacacaaaguacgacgaaaacgacaagcugaucagagaagucaaggucaucacacugaagagcaagcuggucagcgacuucagaaaggacuuccaguucuacaaggucagagaaaucaacaacuaccaccacgcacacgacgcauaccugaacgcagucgucggaacagcacugaucaagaaguacccgaagcuggaaagcgaauucgucuacggagacuacaaggucuacgacgucagaaagaugaucgcaaagagcgaacaggaaaucggaaaggcaacagcaaaguacuucuucuacagcaacaucaugaacuucuucaagacagaaaucacacuggcaaacggagaaaucagaaagagaccgcugaucgaaacaaacggagaaacaggagaaaucgucugggacaagggaagagacuucgcaacagucagaaagguccugagcaugccgcaggucaacaucgucaagaagacagaaguccagacaggaggauucagcaaggaaagcauccugccgaagagaaacagcgacaagcugaucgcaagaaagaaggacugggacccgaagaaguacggaggauucgacagcccgacagucgcauacagcguccuggucgucgcaaaggucgaaaagggaaagagcaagaagcugaagagcgucaaggaacugcugggaaucacaaucauggaaagaagcagcuucgaaaagaacccgaucgacuuccuggaagcaaagggauacaaggaagucaagaaggaccugaucaucaagcugccgaaguacagccuguucgaacuggaaaacggaagaaagagaaugcuggcaagcgcaggagaacugcagaagggaaacgaacuggcacugccgagcaaguacgucaacuuccuguaccuggcaagccacuacgaaaagcugaagggaagcccggaagacaacgaacagaagcagcuguucgucgaacagcacaagcacuaccuggacgaaaucaucgaacagaucagcgaauucagcaagagagucauccuggcagacgcaaaccuggacaagguccugagcgcauacaacaagcacagagacaagccgaucagagaacaggcagaaaacaucauccaccuguucacacugacaaaccugggagcaccggcagcauucaaguacuucgacacaacaaucgacagaaagagauacacaagcacaaaggaaguccuggacgcaacacugauccaccagagcaucacaggacuguacgaaacaagaaucgaccugagccagcugggaggagacggaggaggaagcccgaagaagaagagaaagguc

SEQ ID NO: 11 - RNA, 4134 nt, Artificial Sequence
  Synthetic: Cas9 nickase bare coding sequence
gacaagaaguacagcaucggacuggcaaucggaacaaacagcgucggaugggcagucaucacagacgaauacaaggucccgagcaagaaguucaagguccugggaaacacagacagacacagcaucaagaagaaccugaucggagcacugcuguucgacagcggagaaacagcagaagcaacaagacugaagagaacagcaagaagaagauacacaagaagaaagaacagaaucugcuaccugcaggaaaucuucagcaacgaaauggcaaaggucgacgacagcuucuuccacagacuggaagaaagcuuccuggucgaagaagacaagaagcacgaaagacacccgaucuucggaaacaucgucgacgaagucgcauaccacgaaaaguacccgacaaucuaccaccugagaaagaagcuggucgacagcacagacaaggcagaccugagacugaucuaccuggcacuggcacacaugaucaaguucagaggacacuuccugaucgaaggagaccugaacccggacaacagcgacgucgacaagcuguucauccagcugguccagacauacaaccagcuguucgaagaaaacccgaucaacgcaagcggagucgacgcaaaggcaauccugagcgcaagacugagcaagagcagaagacuggaaaaccugaucgcacagcugccgggagaaaagaagaacggacuguucggaaaccugaucgcacugagccugggacugacaccgaacuucaagagcaacuucgaccuggcagaagacgcaaagcugcagcugagcaaggacacauacgacgacgaccuggacaaccugcuggcacagaucggagaccaguacgcagaccuguuccuggcagcaaagaaccugagcgacgcaauccugcugagcgacauccugagagucaacacagaaaucacaaaggcaccgcugagcgcaagcaugaucaagagauacgacgaacaccaccaggaccugacacugcugaaggcacuggucagacagcagcugccggaaaaguacaaggaaaucuucuucgaccagagcaagaacggauacgcaggauacaucgacggaggagcaagccaggaagaauucuacaaguucaucaagccgauccuggaaaagauggacggaacagaagaacugcuggucaagcugaacagagaagaccugcugagaaagcagagaacauucgacaacggaagcaucccgcaccagauccaccugggagaacugcacgcaauccugagaagacaggaagacuucuacccguuccugaaggacaacagagaaaagaucgaaaagauccugacauucagaaucccguacuacgucggaccgcuggcaagaggaaacagcagauucgcauggaugacaagaaagagcgaagaaacaaucacaccguggaacuucgaagaagucgucgacaagggagcaagcgcacagagcuucaucgaaagaaugacaaacuucgacaagaaccugccgaacgaaaagguccugccgaagcacagccugcuguacgaauacuucacagucuacaacgaacugacaaaggucaaguacgucacagaaggaaugagaaagccggcauuccugagcggagaacagaagaaggcaaucgucgaccugcuguucaagacaaacagaaaggucacagucaagcagcugaaggaagacuacuucaagaagaucgaaugcuucgacagcgucgaaaucagcggagucgaagacagauucaacgcaagccugggaacauaccacgaccugcugaagaucaucaaggacaaggacuuccuggacaacgaagaaaacgaagacauccuggaagacaucguccugacacugacacuguucgaagacagagaaaugaucgaagaaagacugaagacauacgcacaccuguucgacgacaaggucaugaagcagcugaagagaagaagauacacaggauggggaagacugagcagaaagcugaucaacggaaucagagacaagcagagcggaaagacaauccuggacuuccugaagagcgacggauucgcaaacagaaacuucaugcagcugauccacgacgacagccugacauucaaggaagacauccagaaggcacaggucagcggacagggagacagccugcacgaacacaucgcaaaccuggcaggaagcccggcaaucaagaagggaauccugcagacagucaaggucgucgacgaacuggucaaggucaugggaagacacaagccggaaaacaucgucaucgaaauggcaagagaaaaccagacaacacagaagggacagaagaacagcagagaaagaaugaagagaaucgaagaaggaaucaaggaacugggaagccagauccugaaggaacacccggucgaaaacacacagcugcagaacgaaaagcuguaccuguacuaccugcagaacggaagagacauguacgucgaccaggaacuggacaucaacagacugagcgacuacgacgucgaccacaucgucccgcagagcuuccugaaggacgacagcaucgacaacaagguccugacaagaagcgacaagaacagaggaaagagcgacaacgucccgagcgaagaagucgucaagaagaugaagaacuacuggagacagcugcugaacgcaaagcugaucacacagagaaaguucgacaaccugacaaaggcagagagaggaggacugagcgaacuggacaaggcaggauucaucaagagacagcuggucgaaacaagacagaucacaaagcacgucgcacagauccuggacagcagaaugaacacaaaguacgacgaaaacgacaagcugaucagagaagucaaggucaucacacugaagagcaagcuggucagcgacuucagaaaggacuuccaguucuacaaggucagagaaaucaacaacuaccaccacgcacacgacgcauaccugaacgcagucgucggaacagcacugaucaagaaguacccgaagcuggaaagcgaauucgucuacggagacuacaaggucuacgacgucagaaagaugaucgcaaagagcgaacaggaaaucggaaaggcaacagcaaaguacuucuucuacagcaacaucaugaacuucuucaagacagaaaucacacuggcaaacggagaaaucagaaagagaccgcugaucgaaacaaacggagaaacaggagaaaucgucugggacaagggaagagacuucgcaacagucagaaagguccugagcaugccgcaggucaacaucgucaagaagacagaaguccagacaggaggauucagcaaggaaagcauccugccgaagagaaacagcgacaagcugaucgcaagaaagaaggacugggacccgaagaaguacggaggauucgacagcccgacagucgcauacagcguccuggucgucgcaaaggucgaaaagggaaagagcaagaagcugaagagcgucaaggaacugcugggaaucacaaucauggaaagaagcagcuucgaaaagaacccgaucgacuuccuggaagcaaagggauacaaggaagucaagaaggaccugaucaucaagcugccgaaguacagccuguucgaacuggaaaacggaagaaagagaaugcuggcaagcgcaggagaacugcagaagggaaacgaacuggcacugccgagcaaguacgucaacuuccuguaccuggcaagccacuacgaaaagcugaagggaagcccggaagacaacgaacagaagcagcuguucgucgaacagcacaagcacuaccuggacgaaaucaucgaacagaucagcgaauucagcaagagagucauccuggcagacgcaaaccuggacaagguccugagcgcauacaacaagcacagagacaagccgaucagagaacaggcagaaaacaucauccaccuguucacacugacaaaccugggagcaccggcagcauucaaguacuucgacacaacaaucgacagaaagagauacacaagcacaaaggaaguccuggacgcaacacugauccaccagagcaucacaggacuguacgaaacaagaaucgaccugagccagcugggaggagacggaggaggaagcccgaagaagaagagaaagguc

SEQ ID NO: 12 - RNA, 4134 nt, Artificial Sequence
  Synthetic: dCas9 bare coding sequence
gacaagaaguacagcaucggacuggcaaucggaacaaacagcgucggaugggcagucaucacagacgaauacaaggucccgagcaagaaguucaagguccugggaaacacagacagacacagcaucaagaagaaccugaucggagcacugcuguucgacagcggagaaacagcagaagcaacaagacugaagagaacagcaagaagaagauacacaagaagaaagaacagaaucugcuaccugcaggaaaucuucagcaacgaaauggcaaaggucgacgacagcuucuuccacagacuggaagaaagcuuccuggucgaagaagacaagaagcacgaaagacacccgaucuucggaaacaucgucgacgaagucgcauaccacgaaaaguacccgacaaucuaccaccugagaaagaagcuggucgacagcacagacaaggcagaccugagacugaucuaccuggcacuggcacacaugaucaaguucagaggacacuuccugaucgaaggagaccugaacccggacaacagcgacgucgacaagcuguucauccagcugguccagacauacaaccagcuguucgaagaaaacccgaucaacgcaagcggagucgacgcaaaggcaauccugagcgcaagacugagcaagagcagaagacuggaaaaccugaucgcacagcugccgggagaaaagaagaacggacuguucggaaaccugaucgcacugagccugggacugacaccgaacuucaagagcaacuucgaccuggcagaagacgcaaagcugcagcugagcaaggacacauacgacgacgaccuggacaaccugcuggcacagaucggagaccaguacgcagaccuguuccuggcagcaaagaaccugagcgacgcaauccugcugagcgacauccugagagucaacacagaaaucacaaaggcaccgcugagcgcaagcaugaucaagagauacgacgaacaccaccaggaccugacacugcugaaggcacuggucagacagcagcugccggaaaaguacaaggaaaucuucuucgaccagagcaagaacggauacgcaggauacaucgacggaggagcaagccaggaagaauucuacaaguucaucaagccgauccuggaaaagauggacggaacagaagaacugcuggucaagcugaacagagaagaccugcugagaaagcagagaacauucgacaacggaagcaucccgcaccagauccaccugggagaacugcacgcaauccugagaagacaggaagacuucuacccguuccugaaggacaacagagaaaagaucgaaaagauccugacauucagaaucccguacuacgucggaccgcuggcaagaggaaacagcagauucgcauggaugacaagaaagagcgaagaaacaaucacaccguggaacuucgaagaagucgucgacaagggagcaagcgcacagagcuucaucgaaagaaugacaaacuucgacaagaaccugccgaacgaaaagguccugccgaagcacagccugcuguacgaauacuucacagucuacaacgaacugacaaaggucaaguacgucacagaaggaaugagaaagccggcauuccugagcggagaacagaagaaggcaaucgucgaccugcuguucaagacaaacagaaaggucacagucaagcagcugaaggaagacuacuucaagaagaucgaaugcuucgacagcgucgaaaucagcggagucgaagacagauucaacgcaagccugggaacauaccacgaccugcugaagaucaucaaggacaaggacuuccuggacaacgaagaaaacgaagacauccuggaagacaucguccugacacugacacuguucgaagacagagaaaugaucgaagaaagacugaagacauacgcacaccuguucgacgacaaggucaugaagcagcugaagagaagaagauacacaggauggggaagacugagcagaaagcugaucaacggaaucagagacaagcagagcggaaagacaauccuggacuuccugaagagcgacggauucgcaaacagaaacuucaugcagcugauccacgacgacagccugacauucaaggaagacauccagaaggcacaggucagcggacagggagacagccugcacgaacacaucgcaaaccuggcaggaagcccggcaaucaagaagggaauccugcagacagucaaggucgucgacgaacuggucaaggucaugggaagacacaagccggaaaacaucgucaucgaaauggcaagagaaaaccagacaacacagaagggacagaagaacagcagagaaagaaugaagagaaucgaagaaggaaucaaggaacugggaagccagauccugaaggaacacccggucgaaaacacacagcugcagaacgaaaagcuguaccuguacuaccugcagaacggaagagacauguacgucgaccaggaacuggacaucaacagacugagcgacuacgacgucgacgcaaucgucccgcagagcuuccugaaggacgacagcaucgacaacaagguccugacaagaagcgacaagaacagaggaaagagcgacaacgucccgagcgaagaagucgucaagaagaugaagaacuacuggagacagcugcugaacgcaaagcugaucacacagagaaaguucgacaaccugacaaaggcagagagaggaggacugagcgaacuggacaaggcaggauucaucaagagacagcuggucgaaacaagacagaucacaaagcacgucgcacagauccuggacagcagaaugaacacaaaguacgacgaaaacgacaagcugaucagagaagucaaggucaucacacugaagagcaagcuggucagcgacuucagaaaggacuuccaguucuacaaggucagagaaaucaacaacuaccaccacgcacacgacgcauaccugaacgcagucgucggaacagcacugaucaagaaguacccgaagcuggaaagcgaauucgucuacggagacuacaaggucuacgacgucagaaagaugaucgcaaagagcgaacaggaaaucggaaaggcaacagcaaaguacuucuucuacagcaacaucaugaacuucuucaagacagaaaucacacuggcaaacggagaaaucagaaagagaccgcugaucgaaacaaacggagaaacaggagaaaucgucugggacaagggaagagacuucgcaacagucagaaagguccugagcaugccgcaggucaacaucgucaagaagacagaaguccagacaggaggauucagcaaggaaagcauccugccgaagagaaacagcgacaagcugaucgcaagaaagaaggacugggacccgaagaaguacggaggauucgacagcccgacagucgcauacagcguccuggucgucgcaaaggucgaaaagggaaagagcaagaagcugaagagcgucaaggaacugcugggaaucacaaucauggaaagaagcagcuucgaaaagaacccgaucgacuuccuggaagcaaagggauacaaggaagucaagaaggaccugaucaucaagcugccgaaguacagccuguucgaacuggaaaacggaagaaagagaaugcuggcaagcgcaggagaacugcagaagggaaacgaacuggcacugccgagcaaguacgucaacuuccuguaccuggcaagccacuacgaaaagcugaagggaagcccggaagacaacgaacagaagcagcuguucgucgaacagcacaagcacuaccuggacgaaaucaucgaacagaucagcgaauucagcaagagagucauccuggcagacgcaaaccuggacaagguccugagcgcauacaacaagcacagagacaagccgaucagagaacaggcagaaaacaucauccaccuguucacacugacaaaccugggagcaccggcagcauucaaguacuucgacacaacaaucgacagaaagagauacacaagcacaaaggaaguccuggacgcaacacugauccaccagagcaucacaggacuguacgaaacaagaaucgaccugagccagcugggaggagacggaggaggaagcccgaagaagaagagaaagguc

SEQ ID NO: 13 - protein, 1368 aa, Artificial Sequence [sequence omitted]

SEQ ID NO: 14 - RNA, 4107 nt, Artificial Sequence
  Synthetic: Cas9 mRNA ORF encoding SEQ ID NO: 13 using minimal uridine codons as listed in Table 3, with start and stop codons
auggacaagaaguacagcaucggacuggacaucggaacaaacagcgucggaugggcagucaucacagacgaauacaaggucccgagcaagaaguucaagguccugggaaacacagacagacacagcaucaagaagaaccugaucggagcacugcuguucgacagcggagaaacagcagaagcaacaagacugaagagaacagcaagaagaagauacacaagaagaaagaacagaaucugcuaccugcaggaaaucuucagcaacgaaauggcaaaggucgacgacagcuucuuccacagacuggaagaaagcuuccuggucgaagaagacaagaagcacgaaagacacccgaucuucggaaacaucgucgacgaagucgcauaccacgaaaaguacccgacaaucuaccaccugagaaagaagcuggucgacagcacagacaaggcagaccugagacugaucuaccuggcacuggcacacaugaucaaguucagaggacacuuccugaucgaaggagaccugaacccggacaacagcgacgucgacaagcuguucauccagcugguccagacauacaaccagcuguucgaagaaaacccgaucaacgcaagcggagucgacgcaaaggcaauccugagcgcaagacugagcaagagcagaagacuggaaaaccugaucgcacagcugccgggagaaaagaagaacggacuguucggaaaccugaucgcacugagccugggacugacaccgaacuucaagagcaacuucgaccuggcagaagacgcaaagcugcagcugagcaaggacacauacgacgacgaccuggacaaccugcuggcacagaucggagaccaguacgcagaccuguuccuggcagcaaagaaccugagcgacgcaauccugcugagcgacauccugagagucaacacagaaaucacaaaggcaccgcugagcgcaagcaugaucaagagauacgacgaacaccaccaggaccugacacugcugaaggcacuggucagacagcagcugccggaaaaguacaaggaaaucuucuucgaccagagcaagaacggauacgcaggauacaucgacggaggagcaagccaggaagaauucuacaaguucaucaagccgauccuggaaaagauggacggaacagaagaacugcuggucaagcugaacagagaagaccugcugagaaagcagagaacauucgacaacggaagcaucccgcaccagauccaccugggagaacugcacgcaauccugagaagacaggaagacuucuacccguuccugaaggacaacagagaaaagaucgaaaagauccugacauucagaaucccguacuacgucggaccgcuggcaagaggaaacagcagauucgcauggaugacaagaaagagcgaagaaacaaucacaccguggaacuucgaagaagucgucgacaagggagcaagcgcacagagcuucaucgaaagaaugacaaacuucgacaagaaccugccgaacgaaaagguccugccgaagcacagccugcuguacgaauacuucacagucuacaacgaacugacaaaggucaaguacgucacagaaggaaugagaaagccggcauuccugagcggagaacagaagaaggcaaucgucgaccugcuguucaagacaaacagaaaggucacagucaagcagcugaaggaagacuacuucaagaagaucgaaugcuucgacagcgucgaaaucagcggagucgaagacagauucaacgcaagccugggaacauaccacgaccugcugaagaucaucaaggacaaggacuuccuggacaacgaagaaaacgaagacauccuggaagacaucguccugacacugacacuguucgaagacagagaaaugaucgaagaaagacugaagacauacgcacaccuguucgacgacaaggucaugaagcagcugaagagaagaagauacacaggauggggaagacugagcagaaagcugaucaacggaaucagagacaagcagagcggaaagacaauccuggacuuccugaagagcgacggauucgcaaacagaaacuucaugcagcugauccacgacgacagccugacauucaaggaagacauccagaaggcacaggucagcggacagggagacagccugcacgaacacaucgcaaaccuggcaggaagcccggcaaucaagaagggaauccugcagacagucaaggucgucgacgaacuggucaaggucaugggaagacacaagccggaaaacaucgucaucgaaauggcaagagaaaaccagacaacacagaagggacagaagaacagcagagaaagaaugaagagaaucgaagaaggaaucaaggaacugggaagccagauccugaaggaacacccggucgaaaacacacagcugcagaacgaaaagcuguaccuguacuaccugcagaacggaagagacauguacgucgaccaggaacuggacaucaacagacugagcgacuacgacgucgaccacaucgucccgcagagcuuccugaaggacgacagcaucgacaacaagguccugacaagaagcgacaagaacagaggaaagagcgacaacgucccgagcgaagaagucgucaagaagaugaagaacuacuggagacagcugcugaacgcaaagcugaucacacagagaaaguucgacaaccugacaaaggcagagagaggaggacugagcgaacuggacaaggcaggauucaucaagagacagcuggucgaaacaagacagaucacaaagcacgucgcacagauccuggacagcagaaugaacacaaaguacgacgaaaacgacaagcugaucagagaagucaaggucaucacacugaagagcaagcuggucagcgacuucagaaaggacuuccaguucuacaaggucagagaaaucaacaacuaccaccacgcacacgacgcauaccugaacgcagucgucggaacagcacugaucaagaaguacccgaagcuggaaagcgaauucgucuacggagacuacaaggucuacgacgucagaaagaugaucgcaaagagcgaacaggaaaucggaaaggcaacagcaaaguacuucuucuacagcaacaucaugaacuucuucaagacagaaaucacacuggcaaacggagaaaucagaaagagaccgcugaucgaaacaaacggagaaacaggagaaaucgucugggacaagggaagagacuucgcaacagucagaaagguccugagcaugccgcaggucaacaucgucaagaagacagaaguccagacaggaggauucagcaaggaaagcauccugccgaagagaaacagcgacaagcugaucgcaagaaagaaggacugggacccgaagaaguacggaggauucgacagcccgacagucgcauacagcguccuggucgucgcaaaggucgaaaagggaaagagcaagaagcugaagagcgucaaggaacugcugggaaucacaaucauggaaagaagcagcuucgaaaagaacccgaucgacuuccuggaagcaaagggauacaaggaagucaagaaggaccugaucaucaagcugccgaaguacagccuguucgaacuggaaaacggaagaaagagaaugcuggcaagcgcaggagaacugcagaagggaaacgaacuggcacugccgagcaaguacgucaacuuccuguaccuggcaagccacuacgaaaagcugaagggaagcccggaagacaacgaacagaagcagcuguucgucgaacagcacaagcacuaccuggacgaaaucaucgaacagaucagcgaauucagcaagagagucauccuggcagacgcaaaccuggacaagguccugagcgcauacaacaagcacagagacaagccgaucagagaacaggcagaaaacaucauccaccuguucacacugacaaaccugggagcaccggcagcauucaaguacuucgacacaacaaucgacagaaagagauacacaagcacaaaggaaguccuggacgcaacacugauccaccagagcaucacaggacuguacgaaacaagaaucgaccugagccagcugggaggagacuag

SEQ ID NO: 15 - RNA, 4101 nt, Artificial Sequence
  Synthetic: Cas9 coding sequence encoding SEQ ID NO: 13 using minimal uridine codons as listed in Table 3 (no start or stop codons; suitable for inclusion in fusion protein coding sequence)
gacaagaaguacagcaucggacuggacaucggaacaaacagcgucggaugggcagucaucacagacgaauacaaggucccgagcaagaaguucaagguccugggaaacacagacagacacagcaucaagaagaaccugaucggagcacugcuguucgacagcggagaaacagcagaagcaacaagacugaagagaacagcaagaagaagauacacaagaagaaagaacagaaucugcuaccugcaggaaaucuucagcaacgaaauggcaaaggucgacgacagcuucuuccacagacuggaagaaagcuuccuggucgaagaagacaagaagcacgaaagacacccgaucuucggaaacaucgucgacgaagucgcauaccacgaaaaguacccgacaaucuaccaccugagaaagaagcuggucgacagcacagacaaggcagaccugagacugaucuaccuggcacuggcacacaugaucaaguucagaggacacuuccugaucgaaggagaccugaacccggacaacagcgacgucgacaagcuguucauccagcugguccagacauacaaccagcuguucgaagaaaacccgaucaacgcaagcggagucgacgcaaaggcaauccugagcgcaagacugagcaagagcagaagacuggaaaaccugaucgcacagcugccgggagaaaagaagaacggacuguucggaaaccugaucgcacugagccugggacugacaccgaacuucaagagcaacuucgaccuggcagaagacgcaaagcugcagcugagcaaggacacauacgacgacgaccuggacaaccugcuggcacagaucggagaccaguacgcagaccuguuccuggcagcaaagaaccugagcgacgcaauccugcugagcgacauccugagagucaacacagaaaucacaaaggcaccgcugagcgcaagcaugaucaagagauacgacgaacaccaccaggaccugacacugcugaaggcacuggucagacagcagcugccggaaaaguacaaggaaaucuucuucgaccagagcaagaacggauacgcaggauacaucgacggaggagcaagccaggaagaauucuacaaguucaucaagccgauccuggaaaagauggacggaacagaagaacugcuggucaagcugaacagagaagaccugcugagaaagcagagaacauucgacaacggaagcaucccgcaccagauccaccugggagaacugcacgcaauccugagaagacaggaagacuucuacccguuccugaaggacaacagagaaaagaucgaaaagauccugacauucagaaucccguacuacgucggaccgcuggcaagaggaaacagcagauucgcauggaugacaagaaagagcgaagaaacaaucacaccguggaacuucgaagaagucgucgacaagggagcaagcgcacagagcuucaucgaaagaaugacaaacuucgacaagaaccugccgaacgaaaagguccugccgaagcacagccugcuguacgaauacuucacagucuacaacgaacugacaaaggucaaguacgucacagaaggaaugagaaagccggcauuccugagcggagaacagaagaaggcaaucgucgaccugcuguucaagacaaacagaaaggucacagucaagcagcugaaggaagacuacuucaagaagaucgaaugcuucgacagcgucgaaaucagcggagucgaagacagauucaacgcaagccugggaacauaccacgaccugcugaagaucaucaaggacaaggacuuccuggacaacgaagaaaacgaagacauccuggaagacaucguccugacacugacacuguucgaagacagagaaaugaucgaagaaagacugaagacauacgcacaccuguucgacgacaaggucaugaagcagcugaagagaagaagauacacaggauggggaagacugagcagaaagcugaucaacggaaucagagacaagcagagcggaaagacaauccuggacuuccugaagagcgacggauucgcaaacagaaacuucaugcagcugauccacgacgacagccugacauucaaggaagacauccagaaggcacaggucagcggacagggagacagccugcacgaacacaucgcaaaccuggcaggaagcccggcaaucaagaagggaauccugcagacagucaaggucgucgacgaacuggucaaggucaugggaagacacaagccggaaaacaucgucaucgaaauggcaagagaaaaccagacaacacagaagggacagaagaacagcagagaaagaaugaagagaaucgaagaaggaaucaaggaacugggaagccagauccugaaggaacacccggucgaaaacacacagcugcagaacgaaaagcuguaccuguacuaccugcagaacggaagagacauguacgucgaccaggaacuggacaucaacagacugagcgacuacgacgucgaccacaucgucccgcagagcuuccugaaggacgacagcaucgacaacaagguccugacaagaagcgacaagaacagaggaaagagcgacaacgucccgagcgaagaagucgucaagaagaugaagaacuacuggagacagcugcugaacgcaaagcugaucacacagagaaaguucgacaaccugacaaaggcagagagaggaggacugagcgaacuggacaaggcaggauucaucaagagacagcuggucgaaacaagacagaucacaaagcacgucgcacagauccuggacagcagaaugaacacaaaguacgacgaaaacgacaagcugaucagagaagucaaggucaucacacugaagagcaagcuggucagcgacuucagaaaggacuuccaguucuacaaggucagagaaaucaacaacuaccaccacgcacacgacgcauaccugaacgcagucgucggaacagcacugaucaagaaguacccgaagcuggaaagcgaauucgucuacggagacuacaaggucuacgacgucagaaagaugaucgcaaagagcgaacaggaaaucggaaaggcaacagcaaaguacuucuucuacagcaacaucaugaacuucuucaagacagaaaucacacuggcaaacggagaaaucagaaagagaccgcugaucgaaacaaacggagaaacaggagaaaucgucugggacaagggaagagacuucgcaacagucagaaagguccugagcaugccgcaggucaacaucgucaagaagacagaaguccagacaggaggauucagcaaggaaagcauccugccgaagagaaacagcgacaagcugaucgcaagaaagaaggacugggacccgaagaaguacggaggauucgacagcccgacagucgcauacagcguccuggucgucgcaaaggucgaaaagggaaagagcaagaagcugaagagcgucaaggaacugcugggaaucacaaucauggaaagaagcagcuucgaaaagaacccgaucgacuuccuggaagcaaagggauacaaggaagucaagaaggaccugaucaucaagcugccgaaguacagccuguucgaacuggaaaacggaagaaagagaaugcuggcaagcgcaggagaacugcagaagggaaacgaacuggcacugccgagcaaguacgucaacuuccuguaccuggcaagccacuacgaaaagcugaagggaagcccggaagacaacgaacagaagcagcuguucgucgaacagcacaagcacuaccuggacgaaaucaucgaacagaucagcgaauucagcaagagagucauccuggcagacgcaaaccuggacaagguccugagcgcauacaacaagcacagagacaagccgaucagagaacaggcagaaaacaucauccaccuguucacacugacaaaccugggagcaccggcagcauucaaguacuucgacacaacaaucgacagaaagagauacacaagcacaaaggaaguccuggacgcaacacugauccaccagagcaucacaggacuguacgaaacaagaaucgaccugagccagcugggaggagac

SEQ ID NO: 16 - protein, 1368 aa, Artificial Sequence
  Synthetic: Amino acid sequence of Cas9 nickase (without NLS)
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 17 - RNA, 4107 nt, Artificial Sequence
  Synthetic: Cas9 nickase mRNA ORF encoding SEQ ID NO: 16 using minimal uridine codons as listed in Table 3, with start and stop codons
auggacaagaaguacagcaucggacuggcaaucggaacaaacagcgucggaugggcagucaucacagacgaauacaaggucccgagcaagaaguucaagguccugggaaacacagacagacacagcaucaagaagaaccugaucggagcacugcuguucgacagcggagaaacagcagaagcaacaagacugaagagaacagcaagaagaagauacacaagaagaaagaacagaaucugcuaccugcaggaaaucuucagcaacgaaauggcaaaggucgacgacagcuucuuccacagacuggaagaaagcuuccuggucgaagaagacaagaagcacgaaagacacccgaucuucggaaacaucgucgacgaagucgcauaccacgaaaaguacccgacaaucuaccaccugagaaagaagcuggucgacagcacagacaaggcagaccugagacugaucuaccuggcacuggcacacaugaucaaguucagaggacacuuccugaucgaaggagaccugaacccggacaacagcgacgucgacaagcuguucauccagcugguccagacauacaaccagcuguucgaagaaaacccgaucaacgcaagcggagucgacgcaaaggcaauccugagcgcaagacugagcaagagcagaagacuggaaaaccugaucgcacagcugccgggagaaaagaagaacggacuguucggaaaccugaucgcacugagccugggacugacaccgaacuucaagagcaacuucgaccuggcagaagacgcaaagcugcagcugagcaaggacacauacgacgacgaccuggacaaccugcuggcacagaucggagaccaguacgcagaccuguuccuggcagcaaagaaccugagcgacgcaauccugcugagcgacauccugagagucaacacagaaaucacaaaggcaccgcugagcgcaagcaugaucaagagauacgacgaacaccaccaggaccugacacugcugaaggcacuggucagacagcagcugccggaaaaguacaaggaaaucuucuucgaccagagcaagaacggauacgcaggauacaucgacggaggagcaagccaggaagaauucuacaaguucaucaagccgauccuggaaaagauggacggaacagaagaacugcuggucaagcugaacagagaagaccugcugagaaagcagagaacauucgacaacggaagcaucccgcaccagauccaccugggagaacugcacgcaauccugagaagacaggaagacuucuacccguuccugaaggacaacagagaaaagaucgaaaagauccugacauucagaaucccguacuacgucggaccgcuggcaagaggaaacagcagauucgcauggaugacaagaaagagcgaagaaacaaucacaccguggaacuucgaagaagucgucgacaagggagcaagcgcacagagcuucaucgaaagaaugacaaacuucgacaagaaccugccgaacgaaaagguccugccgaagcacagccugcuguacgaauacuucacagucuacaacgaacugacaaaggucaaguacgucacagaaggaaugagaaagccggcauuccugagcggagaacagaagaaggcaaucgucgaccugcuguucaagacaaacagaaaggucacagucaagcagcugaaggaagacuacuucaagaagaucgaaugcuucgacagcgucgaaaucagcggagucgaagacagauucaacgcaagccugggaacauaccacgaccugcugaagaucaucaaggacaaggacuuccuggacaacgaagaaaacgaagacauccuggaagacaucguccugacacugacacuguucgaagacagagaaaugaucgaagaaagacugaagacauacgcacaccuguucgacgacaaggucaugaagcagcugaagagaagaagauacacaggauggggaagacugagcagaaagcugaucaacggaaucagagacaagcagagcggaaagacaauccuggacuuccugaagagcgacggauucgcaaacagaaacuucaugcagcugauccacgacgacagccugacauucaaggaagacauccagaaggcacaggucagcggacagggagacagccugcacgaacacaucgcaaaccuggcaggaagcccggcaaucaagaagggaauccugcagacagucaaggucgucgacgaacuggucaaggucaugggaagacacaagccggaaaacaucgucaucgaaauggcaagagaaaaccagacaacacagaagggacagaagaacagcagagaaagaaugaagagaaucgaagaaggaaucaaggaacugggaagccagauccugaaggaacacccggucgaaaacacacagcugcagaacgaaaagcuguaccuguacuaccugcagaacggaagagacauguacgucgaccaggaacuggacaucaacagacugagcgacuacgacgucgaccacaucgucccgcagagcuuccugaaggacgacagcaucgacaacaagguccugacaagaagcgacaagaacagaggaaagagcgacaacgucccgagcgaagaagucgucaagaagaugaagaacuacuggagacagcugcugaacgcaaagcugaucacacagagaaaguucgacaaccugacaaaggcagagagaggaggacugagcgaacuggacaaggcaggauucaucaagagacagcuggucgaaacaagacagaucacaaagcacgucgcacagauccuggacagcagaaugaacacaaaguacgacgaaaacgacaagcugaucagagaagucaaggucaucacacugaagagcaagcuggucagcgacuucagaaaggacuuccaguucuacaaggucagagaaaucaacaacuaccaccacgcacacgacgcauaccugaacgcagucgucggaacagcacugaucaagaaguacccgaagcuggaaagcgaauucgucuacggagacuacaaggucuacgacgucagaaagaugaucgcaaagagcgaacaggaaaucggaaaggcaacagcaaaguacuucuucuacagcaacaucaugaacuucuucaagacagaaaucacacuggcaaacggagaaaucagaaagagaccgcugaucgaaacaaacggagaaacaggagaaaucgucugggacaagggaagagacuucgcaacagucagaaagguccugagcaugccgcaggucaacaucgucaagaagacagaaguccagacaggaggauucagcaaggaaagcauccugccgaagagaaacagcgacaagcugaucgcaagaaagaaggacugggacccgaagaaguacggaggauucgacagcccgacagucgcauacagcguccuggucgucgcaaaggucgaaaagggaaagagcaagaagcugaagagcgucaaggaacugcugggaaucacaaucauggaaagaagcagcuucgaaaagaacccgaucgacuuccuggaagcaaagggauacaaggaagucaagaaggaccugaucaucaagcugccgaaguacagccuguucgaacuggaaaacggaagaaagagaaugcuggcaagcgcaggagaacugcagaagggaaacgaacuggcacugccgagcaaguacgucaacuuccuguaccuggcaagccacuacgaaaagcugaagggaagcccggaagacaacgaacagaagcagcuguucgucgaacagcacaagcacuaccuggacgaaaucaucgaacagaucagcgaauucagcaagagagucauccuggcagacgcaaaccuggacaagguccugagcgcauacaacaagcacagagacaagccgaucagagaacaggcagaaaacaucauccaccuguucacacugacaaaccugggagcaccggcagcauucaaguacuucgacacaacaaucgacagaaagagauacacaagcacaaaggaaguccuggacgcaacacugauccaccagagcaucacaggacuguacgaaacaagaaucgaccugagccagcugggaggagacuag

SEQ ID NO: 18 - RNA, 4101 nt, Artificial Sequence
  Synthetic: Cas9 nickase coding sequence encoding SEQ ID NO: 16 using minimal uridine codons as listed in Table 3 (no start or stop codons; suitable for inclusion in fusion protein coding sequence)
gacaagaaguacagcaucggacuggcaaucggaacaaacagcgucggaugggcagucaucacagacgaauacaaggucccgagcaagaaguucaagguccugggaaacacagacagacacagcaucaagaagaaccugaucggagcacugcuguucgacagcggagaaacagcagaagcaacaagacugaagagaacagcaagaagaagauacacaagaagaaagaacagaaucugcuaccugcaggaaaucuucagcaacgaaauggcaaaggucgacgacagcuucuuccacagacuggaagaaagcuuccuggucgaagaagacaagaagcacgaaagacacccgaucuucggaaacaucgucgacgaagucgcauaccacgaaaaguacccgacaaucuaccaccugagaaagaagcuggucgacagcacagacaaggcagaccugagacugaucuaccuggcacuggcacacaugaucaaguucagaggacacuuccugaucgaaggagaccugaacccggacaacagcgacgucgacaagcuguucauccagcugguccagacauacaaccagcuguucgaagaaaacccgaucaacgcaagcggagucgacgcaaaggcaauccugagcgcaagacugagcaagagcagaagacuggaaaaccugaucgcacagcugccgggagaaaagaagaacggacuguucggaaaccugaucgcacugagccugggacugacaccgaacuucaagagcaacuucgaccuggcagaagacgcaaagcugcagcugagcaaggacacauacgacgacgaccuggacaaccugcuggcacagaucggagaccaguacgcagaccuguuccuggcagcaaagaaccugagcgacgcaauccugcugagcgacauccugagagucaacacagaaaucacaaaggcaccgcugagcgcaagcaugaucaagagauacgacgaacaccaccaggaccugacacugcugaaggcacuggucagacagcagcugccggaaaaguacaaggaaaucuucuucgaccagagcaagaacggauacgcaggauacaucgacggaggagcaagccaggaagaauucuacaaguucaucaagccgauccuggaaaagauggacggaacagaagaacugcuggucaagcugaacagagaagaccugcugagaaagcagagaacauucgacaacggaagcaucccgcaccagauccaccugggagaacugcacgcaauccugagaagacaggaagacuucuacccguuccugaaggacaacagagaaaagaucgaaaagauccugacauucagaaucccguacuacgucggaccgcuggcaagaggaaacagcagauucgcauggaugacaagaaagagcgaagaaacaaucacaccguggaacuucgaagaagucgucgacaagggagcaagcgcacagagcuucaucgaaagaaugacaaacuucgacaagaaccugccgaacgaaaagguccugccgaagcacagccugcuguacgaauacuucacagucuacaacgaacugacaaaggucaaguacgucacagaaggaaugagaaagccggcauuccugagcggagaacagaagaaggcaaucgucgaccugcuguucaagacaaacagaaaggucacagucaagcagcugaaggaagacuacuucaagaagaucgaaugcuucgacagcgucgaaaucagcggagucgaagacagauucaacgcaagccugggaacauaccacgaccugcugaagaucaucaaggacaaggacuuccuggacaacgaagaaaacgaagacauccuggaagacaucguccugacacugacacuguucgaagacagagaaaugaucgaagaaagacugaagacauacgcacaccuguucgacgacaaggucaugaagcagcugaagagaagaagauacacaggauggggaagacugagcagaaagcugaucaacggaaucagagacaagcagagcggaaagacaauccuggacuuccugaagagcgacggauucgcaaacagaaacuucaugcagcugauccacgacgacagccugacauucaaggaagacauccagaaggcacaggucagcggacagggagacagccugcacgaacacaucgcaaaccuggcaggaagcccggcaaucaagaagggaauccugcagacagucaaggucgucgacgaacuggucaaggucaugggaagacacaagccggaaaacaucgucaucgaaauggcaagagaaaaccagacaacacagaagggacagaagaacagcagagaaagaaugaagagaaucgaagaaggaaucaaggaacugggaagccagauccugaaggaacacccggucgaaaacacacagcugcagaacgaaaagcuguaccuguacuaccugcagaacggaagagacauguacgucgaccaggaacuggacaucaacagacugagcgacuacgacgucgaccacaucgucccgcagagcuuccugaaggacgacagcaucgacaacaagguccugacaagaagcgacaagaacagaggaaagagcgacaacgucccgagcgaagaagucgucaagaagaugaagaacuacuggagacagcugcugaacgcaaagcugaucacacagagaaaguucgacaaccugacaaaggcagagagaggaggacugagcgaacuggacaaggcaggauucaucaagagacagcuggucgaaacaagacagaucacaaagcacgucgcacagauccuggacagcagaaugaacacaaaguacgacgaaaacgacaagcugaucagagaagucaaggucaucacacugaagagcaagcuggucagcgacuucagaaaggacuuccaguucuacaaggucagagaaaucaacaacuaccaccacgcacacgacgcauaccugaacgcagucgucggaacagcacugaucaagaaguacccgaagcuggaaagcgaauucgucuacggagacuacaaggucuacgacgucagaaagaugaucgcaaagagcgaacaggaaaucggaaaggcaacagcaaaguacuucuucuacagcaacaucaugaacuucuucaagacagaaaucacacuggcaaacggagaaaucagaaagagaccgcugaucgaaacaaacggagaaacaggagaaaucgucugggacaagggaagagacuucgcaacagucagaaagguccugagcaugccgcaggucaacaucgucaagaagacagaaguccagacaggaggauucagcaaggaaagcauccugccgaagagaaacagcgacaagcugaucgcaagaaagaaggacugggacccgaagaaguacggaggauucgacagcccgacagucgcauacagcguccuggucgucgcaaaggucgaaaagggaaagagcaagaagcugaagagcgucaaggaacugcugggaaucacaaucauggaaagaagcagcuucgaaaagaacccgaucgacuuccuggaagcaaagggauacaaggaagucaagaaggaccugaucaucaagcugccgaaguacagccuguucgaacuggaaaacggaagaaagagaaugcuggcaagcgcaggagaacugcagaagggaaacgaacuggcacugccgagcaaguacgucaacuuccuguaccuggcaagccacuacgaaaagcugaagggaagcccggaagacaacgaacagaagcagcuguucgucgaacagcacaagcacuaccuggacgaaaucaucgaacagaucagcgaauucagcaagagagucauccuggcagacgcaaaccuggacaagguccugagcgcauacaacaagcacagagacaagccgaucagagaacaggcagaaaacaucauccaccuguucacacugacaaaccugggagcaccggcagcauucaaguacuucgacacaacaaucgacagaaagagauacacaagcacaaaggaaguccuggacgcaacacugauccaccagagcaucacaggacuguacgaaacaagaaucgaccugagccagcugggaggagac

SEQ ID NO: 19 - protein, 1368 aa, Artificial Sequence
  Synthetic: Amino acid sequence of dCas9 (without NLS)
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 20 - RNA, 4107 nt, Artificial Sequence
  Synthetic: dCas9 mRNA ORF encoding SEQ ID NO: 19 using minimal uridine codons as listed in Table 3, with start and stop codons
auggacaagaaguacagcaucggacuggcaaucggaacaaacagcgucggaugggcagucaucacagacgaauacaaggucccgagcaagaaguucaagguccugggaaacacagacagacacagcaucaagaagaaccugaucggagcacugcuguucgacagcggagaaacagcagaagcaacaagacugaagagaacagcaagaagaagauacacaagaagaaagaacagaaucugcuaccugcaggaaaucuucagcaacgaaauggcaaaggucgacgacagcuucuuccacagacuggaagaaagcuuccuggucgaagaagacaagaagcacgaaagacacccgaucuucggaaacaucgucgacgaagucgcauaccacgaaaaguacccgacaaucuaccaccugagaaagaagcuggucgacagcacagacaaggcagaccugagacugaucuaccuggcacuggcacacaugaucaaguucagaggacacuuccugaucgaaggagaccugaacccggacaacagcgacgucgacaagcuguucauccagcugguccagacauacaaccagcuguucgaagaaaacccgaucaacgcaagcggagucgacgcaaaggcaauccugagcgcaagacugagcaagagcagaagacuggaaaaccugaucgcacagcugccgggagaaaagaagaacggacuguucggaaaccugaucgcacugagccugggacugacaccgaacuucaagagcaacuucgaccuggcagaagacgcaaagcugcagcugagcaaggacacauacgacgacgaccuggacaaccugcuggcacagaucggagaccaguacgcagaccuguuccuggcagcaaagaaccugagcgacgcaauccugcugagcgacauccugagagucaacacagaaaucacaaaggcaccgcugagcgcaagcaugaucaagagauacgacgaacaccaccaggaccugacacugcugaaggcacuggucagacagcagcugccggaaaaguacaaggaaaucuucuucgaccagagcaagaacggauacgcaggauacaucgacggaggagcaagccaggaagaauucuacaaguucaucaagccgauccuggaaaagauggacggaacagaagaacugcuggucaagcugaacagagaagaccugcugagaaagcagagaacauucgacaacggaagcaucccgcaccagauccaccugggagaacugcacgcaauccugagaagacaggaagacuucuacccguuccugaaggacaacagagaaaagaucgaaaagauccugacauucagaaucccguacuacgucggaccgcuggcaagaggaaacagcagauucgcauggaugacaagaaagagcgaagaaacaaucacaccguggaacuucgaagaagucgucgacaagggagcaagcgcacagagcuucaucgaaagaaugacaaacuucgacaagaaccugccgaacgaaaagguccugccgaagcacagccugcuguacgaauacuucacagucuacaacgaacugacaaaggucaaguacgucacagaaggaaugagaaagccggcauuccugagcggagaacagaagaaggcaaucgucgaccugcuguucaagacaaacagaaaggucacagucaagcagcugaaggaagacuacuucaagaagaucgaaugcuucgacagcgucgaaaucagcggagucgaagacagauucaacgcaagccugggaacauaccacgaccugcugaagaucaucaaggacaaggacuuccuggacaacgaagaaaacgaagacauccuggaagacaucguccugacacugacacuguucgaagacagagaaaugaucgaagaaagacugaagacauacgcacaccuguucgacgacaaggucaugaagcagcugaagagaagaagauacacaggauggggaagacugagcagaaagcugaucaacggaaucagagacaagcagagcggaaagacaauccuggacuuccugaagagcgacggauucgcaaacagaaacuucaugcagcugauccacgacgacagccugacauucaaggaagacauccagaaggcacaggucagcggacagggagacagccugcacgaacacaucgcaaaccuggcaggaagcccggcaaucaagaagggaauccugcagacagucaaggucgucgacgaacuggucaaggucaugggaagacacaagccggaaaacaucgucaucgaaauggcaagagaaaaccagacaacacagaagggacagaagaacagcagagaaagaaugaagagaaucgaagaaggaaucaaggaacugggaagccagauccugaaggaacacccggucgaaaacacacagcugcagaacgaaaagcuguaccuguacuaccugcagaacggaagagacauguacgucgaccaggaacuggacaucaacagacugagcgacuacgacgucgacgcaaucgucccgcagagcuuccugaaggacgacagcaucgacaacaagguccugacaagaagcgacaagaacagaggaaagagcgacaacgucccgagcgaagaagucgucaagaagaugaagaacuacuggagacagcugcugaacgcaaagcugaucacacagagaaaguucgacaaccugacaaaggcagagagaggaggacugagcgaacuggacaaggcaggauucaucaagagacagcuggucgaaacaagacagaucacaaagcacgucgcacagauccuggacagcagaaugaacacaaaguacgacgaaaacgacaagcugaucagagaagucaaggucaucacacugaagagcaagcuggucagcgacuucagaaaggacuuccaguucuacaaggucagagaaaucaacaacuaccaccacgcacacgacgcauaccugaacgcagucgucggaacagcacugaucaagaaguacccgaagcuggaaagcgaauucgucuacggagacuacaaggucuacgacgucagaaagaugaucgcaaagagcgaacaggaaaucggaaaggcaacagcaaaguacuucuucuacagcaacaucaugaacuucuucaagacagaaaucacacuggcaaacggagaaaucagaaagagaccgcugaucgaaacaaacggagaaacaggagaaaucgucugggacaagggaagagacuucgcaacagucagaaagguccugagcaugccgcaggucaacaucgucaagaagacagaaguccagacaggaggauucagcaaggaaagcauccugccgaagagaaacagcgacaagcugaucgcaagaaagaaggacugggacccgaagaaguacggaggauucgacagcccgacagucgcauacagcguccuggucgucgcaaaggucgaaaagggaaagagcaagaagcugaagagcgucaaggaacugcugggaaucacaaucauggaaagaagcagcuucgaaaagaacccgaucgacuuccuggaagcaaagggauacaaggaagucaagaaggaccugaucaucaagcugccgaaguacagccuguucgaacuggaaaacggaagaaagagaaugcuggcaagcgcaggagaacugcagaagggaaacgaacuggcacugccgagcaaguacgucaacuuccuguaccuggcaagccacuacgaaaagcugaagggaagcccggaagacaacgaacagaagcagcuguucgucgaacagcacaagcacuaccuggacgaaaucaucgaacagaucagcgaauucagcaagagagucauccuggcagacgcaaaccuggacaagguccugagcgcauacaacaagcacagagacaagccgaucagagaacaggcagaaaacaucauccaccuguucacacugacaaaccugggagcaccggcagcauucaaguacuucgacacaacaaucgacagaaagagauacacaagcacaaaggaaguccuggacgcaacacugauccaccagagcaucacaggacuguacgaaacaagaaucgaccugagccagcugggaggagacuag

SEQ ID NO: 21 - RNA, 4113 nt, Artificial Sequence
  Synthetic: dCas9 coding sequence encoding SEQ ID NO: 19 using minimal uridine codons as listed in Table 3 (no start or stop codons; suitable for inclusion in fusion protein coding sequence)
gacaagaaguacagcaucggacuggcaaucggaacaaacagcgucggaugggcagucaucacagacgaauacaaggucccgagcaagaaguucaagguccugggaaacacagacagacacagcaucaagaagaaccugaucggagcacugcuguucgacagcggagaaacagcagaagcaacaagacugaagagaacagcaagaagaagauacacaagaagaaagaacagaaucugcuaccugcaggaaaucuucagcaacgaaauggcaaaggucgacgacagcuucuuccacagacuggaagaaagcuuccuggucgaagaagacaagaagcacgaaagacacccgaucuucggaaacaucgucgacgaagucgcauaccacgaaaaguacccgacaaucuaccaccugagaaagaagcuggucgacagcacagacaaggcagaccugagacugaucuaccuggcacuggcacacaugaucaaguucagaggacacuuccugaucgaaggagaccugaacccggacaacagcgacgucgacaagcuguucauccagcugguccagacauacaaccagcuguucgaagaaaacccgaucaacgcaagcggagucgacgcaaaggcaauccugagcgcaagacugagcaagagcagaagacuggaaaaccugaucgcacagcugccgggagaaaagaagaacggacuguucggaaaccugaucgcacugagccugggacugacaccgaacuucaagagcaacuucgaccuggcagaagacgcaaagcugcagcugagcaaggacacauacgacgacgaccuggacaaccugcuggcacagaucggagaccaguacgcagaccuguuccuggcagcaaagaaccugagcgacgcaauccugcugagcgacauccugagagucaacacagaaaucacaaaggcaccgcugagcgcaagcaugaucaagagauacgacgaacaccaccaggaccugacacugcugaaggcacuggucagacagcagcugccggaaaaguacaaggaaaucuucuucgaccagagcaagaacggauacgcaggauacaucgacggaggagcaagccaggaagaauucuacaaguucaucaagccgauccuggaaaagauggacggaacagaagaacugcuggucaagcugaacagagaagaccugcugagaaagcagagaacauucgacaacggaagcaucccgcaccagauccaccugggagaacugcacgcaauccugagaagacaggaagacuucuacccguuccugaaggacaacagagaaaagaucgaaaagauccugacauucagaaucccguacuacgucggaccgcuggcaagaggaaacagcagauucgcauggaugacaagaaagagcgaagaaacaaucacaccguggaacuucgaagaagucgucgacaagggagcaagcgcacagagcuucaucgaaagaaugacaaacuucgacaagaaccugccgaacgaaaagguccugccgaagcacagccugcuguacgaauacuucacagucuacaacgaacugacaaaggucaaguacgucacagaaggaaugagaaagccggcauuccugagcggagaacagaagaaggcaaucgucgaccugcuguucaagacaaacagaaaggucacagucaagcagcugaaggaagacuacuucaagaagaucgaaugcuucgacagcgucgaaaucagcggagucgaagacagauucaacgcaagccugggaacauaccacgaccugcugaagaucaucaaggacaaggacuuccuggacaacgaagaaaacgaagacauccuggaagacaucguccugacacugacacuguucgaagacagagaaaugaucgaagaaagacugaagacauacgcacaccuguucgacgacaaggucaugaagcagcugaagagaagaagauacacaggauggggaagacugagcagaaagcugaucaacggaaucagagacaagcagagcggaaagacaauccuggacuuccugaagagcgacggauucgcaaacagaaacuucaugcagcugauccacgacgacagccugacauucaaggaagacauccagaaggcacaggucagcggacagggagacagccugcacgaacacaucgcaaaccuggcaggaagcccggcaaucaagaagggaauccugcagacagucaaggucgucgacgaacuggucaaggucaugggaagacacaagccggaaaacaucgucaucgaaauggcaagagaaaaccagacaacacagaagggacagaagaacagcagagaaagaaugaagagaaucgaagaaggaaucaaggaacugggaagccagauccugaaggaacacccggucgaaaacacacagcugcagaacgaaaagcuguaccuguacuaccugcagaacggaagagacauguacgucgaccaggaacuggacaucaacagacugagcgacuacgacgucgacgcaaucgucccgcagagcuuccugaaggacgacagcaucgacaacaagguccugacaagaagcgacaagaacagaggaaagagcgacaacgucccgagcgaagaagucgucaagaagaugaagaacuacuggagacagcugcugaacgcaaagcugaucacacagagaaaguucgacaaccugacaaaggcagagagaggaggacugagcgaacuggacaaggcaggauucaucaagagacagcuggucgaaacaagacagaucacaaagcacgucgcacagauccuggacagcagaaugaacacaaaguacgacgaaaacgacaagcugaucagagaagucaaggucaucacacugaagagcaagcuggucagcgacuucagaaaggacuuccaguucuacaaggucagagaaaucaacaacuaccaccacgcacacgacgcauaccugaacgcagucgucggaacagcacugaucaagaaguacccgaagcuggaaagcgaauucgucuacggagacuacaaggucuacgacgucagaaagaugaucgcaaagagcgaacaggaaaucggaaaggcaacagcaaaguacuucuucuacagcaacaucaugaacuucuucaagacagaaaucacacuggcaaacggagaaaucagaaagagaccgcugaucgaaacaaacggagaaacaggagaaaucgucugggacaagggaagagacuucgcaacagucagaaagguccugagcaugccgcaggucaacaucgucaagaagacagaaguccagacaggaggauucagcaaggaaagcauccugccgaagagaaacagcgacaagcugaucgcaagaaagaaggacugggacccgaagaaguacggaggauucgacagcccgacagucgcauacagcguccuggucgucgcaaaggucgaaaagggaaagagcaagaagcugaagagcgucaaggaacugcugggaaucacaaucauggaaagaagcagcuucgaaaagaacccgaucgacuuccuggaagcaaagggauacaaggaagucaagaaggaccugaucaucaagcugccgaaguacagccuguucgaacuggaaaacggaagaaagagaaugcuggcaagcgcaggagaacugcagaagggaaacgaacuggcacugccgagcaaguacgucaacuuccuguaccuggcaagccacuacgaaaagcugaagggaagcccggaagacaacgaacagaagcagcuguucgucgaacagcacaagcacuaccuggacgaaaucaucgaacagaucagcgaauucagcaagagagucauccuggcagacgcaaaccuggacaagguccugagcgcauacaacaagcacagagacaagccgaucagagaacaggcagaaaacaucauccaccuguucacacugacaaaccugggagcaccggcagcauucaaguacuucgacacaacaaucgacagaaagagauacacaagcacaaaggaaguccuggacgcaacacugauccaccagagcaucacaggacuguacgaaacaagaaucgaccugagccagcugggaggagacggaggaggaagc

SEQ ID NO: 22 - protein, 1392 aa, Artificial Sequence
  Synthetic: Amino acid sequence of Cas9 with two nuclear localization signals as the C-terminal amino acids
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSGSPKKKRKVDGSPKKKRKVDSG

SEQ ID NO: 23 - RNA, 4179 nt, Artificial Sequence
  Synthetic: Cas9 mRNA ORF encoding SEQ ID NO: 22 using minimal uridine codons as listed in Table 3, with start and stop codons
auggacaagaaguacagcaucggacuggacaucggaacaaacagcgucggaugggcagucaucacagacgaauacaaggucccgagcaagaaguucaagguccugggaaacacagacagacacagcaucaagaagaaccugaucggagcacugcuguucgacagcggagaaacagcagaagcaacaagacugaagagaacagcaagaagaagauacacaagaagaaagaacagaaucugcuaccugcaggaaaucuucagcaacgaaauggcaaaggucgacgacagcuucuuccacagacuggaagaaagcuuccuggucgaagaagacaagaagcacgaaagacacccgaucuucggaaacaucgucgacgaagucgcauaccacgaaaaguacccgacaaucuaccaccugagaaagaagcuggucgacagcacagacaaggcagaccugagacugaucuaccuggcacuggcacacaugaucaaguucagaggacacuuccugaucgaaggagaccugaacccggacaacagcgacgucgacaagcuguucauccagcugguccagacauacaaccagcuguucgaagaaaacccgaucaacgcaagcggagucgacgcaaaggcaauccugagcgcaagacugagcaagagcagaagacuggaaaaccugaucgcacagcugccgggagaaaagaagaacggacuguucggaaaccugaucgcacugagccugggacugacaccgaacuucaagagcaacuucgaccuggcagaagacgcaaagcugcagcugagcaaggacacauacgacgacgaccuggacaaccugcuggcacagaucggagaccaguacgcagaccuguuccuggcagcaaagaaccugagcgacgcaauccugcugagcgacauccugagagucaacacagaaaucacaaaggcaccgcugagcgcaagcaugaucaagagauacgacgaacaccaccaggaccugacacugcugaaggcacuggucagacagcagcugccggaaaaguacaaggaaaucuucuucgaccagagcaagaacggauacgcaggauacaucgacggaggagcaagccaggaagaauucuacaaguucaucaagccgauccuggaaaagauggacggaacagaagaacugcuggucaagcugaacagagaagaccugcugagaaagcagagaacauucgacaacggaagcaucccgcaccagauccaccugggagaacugcacgcaauccugagaagacaggaagacuucuacccguuccugaaggacaacagagaaaagaucgaaaagauccugacauucagaaucccguacuacgucggaccgcuggcaagaggaaacagcagauucgcauggaugacaagaaagagcgaagaaacaaucacaccguggaacuucgaagaagucgucgacaagggagcaagcgcacagagcuucaucgaaagaaugacaaacuucgacaagaaccugccgaacgaaaagguccugccgaagcacagccugcuguacgaauacuucacagucuacaacgaacugacaaaggucaaguacgucacagaaggaaugagaaagccggcauuccugagcggagaacagaagaaggcaaucgucgaccugcuguucaagacaaacagaaaggucacagucaagcagcugaaggaagacuacuucaagaagaucgaaugcuucgacagcgucgaaaucagcggagucgaagacagauucaacgcaagccugggaacauaccacgaccugcugaagaucaucaaggacaaggacuuccuggacaacgaagaaaacgaagacauccuggaagacaucguccugacacugacacuguucgaagacagagaaaugaucgaagaaagacugaagacauacgcacaccuguucgacgacaaggucaugaagcagcugaagagaagaagauacacaggauggggaagacugagcagaaagcugaucaacggaaucagagacaagcagagcggaaagacaauccuggacuuccugaagagcgacggauucgcaaacagaaacuucaugcagcugauccacgacgacagccugacauucaaggaagacauccagaaggcacaggucagcggacagggagacagccugcacgaacacaucgcaaaccuggcaggaagcccggcaaucaagaagggaauccugcagacagucaaggucgucgacgaacuggucaaggucaugggaagacacaagccggaaaacaucgucaucgaaauggcaagagaaaaccagacaacacagaagggacagaagaacagcagagaaagaaugaagagaaucgaagaaggaaucaaggaacugggaagccagauccugaaggaacacccggucgaaaacacacagcugcagaacgaaaagcuguaccuguacuaccugcagaacggaagagacauguacgucgaccaggaacuggacaucaacagacugagcgacuacgacgucgaccacaucgucccgcagagcuuccugaaggacgacagcaucgacaacaagguccugacaagaagcgacaagaacagaggaaagagcgacaacgucccgagcgaagaagucgucaagaagaugaagaacuacuggagacagcugcugaacgcaaagcugaucacacagagaaaguucgacaaccugacaaaggcagagagaggaggacugagcgaacuggacaaggcaggauucaucaagagacagcuggucgaaacaagacagaucacaaagcacgucgcacagauccuggacagcagaaugaacacaaaguacgacgaaaacgacaagcugaucagagaagucaaggucaucacacugaagagcaagcuggucagcgacuucagaaaggacuuccaguucuacaaggucagagaaaucaacaacuaccaccacgcacacgacgcauaccugaacgcagucgucggaacagcacugaucaagaaguacccgaagcuggaaagcgaauucgucuacggagacuacaaggucuacgacgucagaaagaugaucgcaaagagcgaacaggaaaucggaaaggcaacagcaaaguacuucuucuacagcaacaucaugaacuucuucaagacagaaaucacacuggcaaacggagaaaucagaaagagaccgcugaucgaaacaaacggagaaacaggagaaaucgucugggacaagggaagagacuucgcaacagucagaaagguccugagcaugccgcaggucaacaucgucaagaagacagaaguccagacaggaggauucagcaaggaaagcauccugccgaagagaaacagcgacaagcugaucgcaagaaagaaggacugggacccgaagaaguacggaggauucgacagcccgacagucgcauacagcguccuggucgucgcaaaggucgaaaagggaaagagcaagaagcugaagagcgucaaggaacugcugggaaucacaaucauggaaagaagcagcuucgaaaagaacccgaucgacuuccuggaagcaaagggauacaaggaagucaagaaggaccugaucaucaagcugccgaaguacagccuguucgaacuggaaaacggaagaaagagaaugcuggcaagcgcaggagaacugcagaagggaaacgaacuggcacugccgagcaaguacgucaacuuccuguaccuggcaagccacuacgaaaagcugaagggaagcccggaagacaacgaacagaagcagcuguucgucgaacagcacaagcacuaccuggacgaaaucaucgaacagaucagcgaauucagcaagagagucauccuggcagacgcaaaccuggacaagguccugagcgcauacaacaagcacagagacaagccgaucagagaacaggcagaaaacaucauccaccuguucacacugacaaaccugggagcaccggcagcauucaaguacuucgacacaacaaucgacagaaagagauacacaagcacaaaggaaguccuggacgcaacacugauccaccagagcaucacaggacuguacgaaacaagaaucgaccugagccagcugggaggagacggaagcggaagcccgaagaagaagagaaaggucgacggaagcccgaagaagaagagaaaggucgacagcggauag

SEQ ID NO: 24 - RNA, 4173 nt, Artificial Sequence
  Synthetic: Cas9 coding sequence encoding SEQ ID NO: 23 using minimal uridine codons as listed in Table 3 (no start or stop codons; suitable for inclusion in fusion protein coding sequence)
gacaagaaguacagcaucggacuggacaucggaacaaacagcgucggaugggcagucaucacagacgaauacaaggucccgagcaagaaguucaagguccugggaaacacagacagacacagcaucaagaagaaccugaucggagcacugcuguucgacagcggagaaacagcagaagcaacaagacugaagagaacagcaagaagaagauacacaagaagaaagaacagaaucugcuaccugcaggaaaucuucagcaacgaaauggcaaaggucgacgacagcuucuuccacagacuggaagaaagcuuccuggucgaagaagacaagaagcacgaaagacacccgaucuucggaaacaucgucgacgaagucgcauaccacgaaaaguacccgacaaucuaccaccugagaaagaagcuggucgacagcacagacaaggcagaccugagacugaucuaccuggcacuggcacacaugaucaaguucagaggacacuuccugaucgaaggagaccugaacccggacaacagcgacgucgacaagcuguucauccagcugguccagacauacaaccagcuguucgaagaaaacccgaucaacgcaagcggagucgacgcaaaggcaauccugagcgcaagacugagcaagagcagaagacuggaaaaccugaucgcacagcugccgggagaaaagaagaacggacuguucggaaaccugaucgcacugagccugggacugacaccgaacuucaagagcaacuucgaccuggcagaagacgcaaagcugcagcugagcaaggacacauacgacgacgaccuggacaaccugcuggcacagaucggagaccaguacgcagaccuguuccuggcagcaaagaaccugagcgacgcaauccugcugagcgacauccugagagucaacacagaaaucacaaaggcaccgcugagcgcaagcaugaucaagagauacgacgaacaccaccaggaccugacacugcugaaggcacuggucagacagcagcugccggaaaaguacaaggaaaucuucuucgaccagagcaagaacggauacgcaggauacaucgacggaggagcaagccaggaagaauucuacaaguucaucaagccgauccuggaaaagauggacggaacagaagaacugcuggucaagcugaacagagaagaccugcugagaaagcagagaacauucgacaacggaagcaucccgcaccagauccaccugggagaacugcacgcaauccugagaagacaggaagacuucuacccguuccugaaggacaacagagaaaagaucgaaaagauccugacauucagaaucccguacuacgucggaccgcuggcaagaggaaacagcagauucgcauggaugacaagaaagagcgaagaaacaaucacaccguggaacuucgaagaagucgucgacaagggagcaagcgcacagagcuucaucgaaagaaugacaaacuucgacaagaaccugccgaacgaaaagguccugccgaagcacagccugcuguacgaauacuucacagucuacaacgaacugacaaaggucaaguacgucacagaaggaaugagaaagccggcauuccugagcggagaacagaagaaggcaaucgucgaccugcuguucaagacaaacagaaaggucacagucaagcagcugaaggaagacuacuucaagaagaucgaaugcuucgacagcgucgaaaucagcggagucgaagacagauucaacgcaagccugggaacauaccacgaccugcugaagaucaucaaggacaaggacuuccuggacaacgaagaaaacgaagacauccuggaagacaucguccugacacugacacuguucgaagacagagaaaugaucgaagaaagacugaagacauacgcacaccuguucgacgacaaggucaugaagcagcugaagagaagaagauacacaggauggggaagacugagcagaaagcugaucaacggaaucagagacaagcagagcggaaagacaauccuggacuuccugaagagcgacggauucgcaaacagaaacuucaugcagcugauccacgacgacagccugacauucaaggaagacauccagaaggcacaggucagcggacagggagacagccugcacgaacacaucgcaaaccuggcaggaagcccggcaaucaagaagggaauccugcagacagucaaggucgucgacgaacuggucaaggucaugggaagacacaagccggaaaacaucgucaucgaaauggcaagagaaaaccagacaacacagaagggacagaagaacagcagagaaagaaugaagagaaucgaagaaggaaucaaggaacugggaagccagauccugaaggaacacccggucgaaaacacacagcugcagaacgaaaagcuguaccuguacuaccugcagaacggaagagacauguacgucgaccaggaacuggacaucaacagacugagcgacuacgacgucgaccacaucgucccgcagagcuuccugaaggacgacagcaucgacaacaagguccugacaagaagcgacaagaacagaggaaagagcgacaacgucccgagcgaagaagucgucaagaagaugaagaacuacuggagacagcugcugaacgcaaagcugaucacacagagaaaguucgacaaccugacaaaggcagagagaggaggacugagcgaacuggacaaggcaggauucaucaagagacagcuggucgaaacaagacagaucacaaagcacgucgcacagauccuggacagcagaaugaacacaaaguacgacgaaaacgacaagcugaucagagaagucaaggucaucacacugaagagcaagcuggucagcgacuucagaaaggacuuccaguucuacaaggucagagaaaucaacaacuaccaccacgcacacgacgcauaccugaacgcagucgucggaacagcacugaucaagaaguacccgaagcuggaaagcgaauucgucuacggagacuacaaggucuacgacgucagaaagaugaucgcaaagagcgaacaggaaaucggaaaggcaacagcaaaguacuucuucuacagcaacaucaugaacuucuucaagacagaaaucacacuggcaaacggagaaaucagaaagagaccgcugaucgaaacaaacggagaaacaggagaaaucgucugggacaagggaagagacuucgcaacagucagaaagguccugagcaugccgcaggucaacaucgucaagaagacagaaguccagacaggaggauucagcaaggaaagcauccugccgaagagaaacagcgacaagcugaucgcaagaaagaaggacugggacccgaagaaguacggaggauucgacagcccgacagucgcauacagcguccuggucgucgcaaaggucgaaaagggaaagagcaagaagcugaagagcgucaaggaacugcugggaaucacaaucauggaaagaagcagcuucgaaaagaacccgaucgacuuccuggaagcaaagggauacaaggaagucaagaaggaccugaucaucaagcugccgaaguacagccuguucgaacuggaaaacggaagaaagagaaugcuggcaagcgcaggagaacugcagaagggaaacgaacuggcacugccgagcaaguacgucaacuuccuguaccuggcaagccacuacgaaaagcugaagggaagcccggaagacaacgaacagaagcagcuguucgucgaacagcacaagcacuaccuggacgaaaucaucgaacagaucagcgaauucagcaagagagucauccuggcagacgcaaaccuggacaagguccugagcgcauacaacaagcacagagacaagccgaucagagaacaggcagaaaacaucauccaccuguucacacugacaaaccugggagcaccggcagcauucaaguacuucgacacaacaaucgacagaaagagauacacaagcacaaaggaaguccuggacgcaacacugauccaccagagcaucacaggacuguacgaaacaagaaucgaccugagccagcugggaggagacggaagcggaagcccgaagaagaagagaaaggucgacggaagcccgaagaagaagagaaaggucgacagcgga

SEQ ID NO: 25 - protein, 1392 aa, Artificial Sequence
  Synthetic: Amino acid sequence of Cas9 nickase with two nuclear localization signals as the C-terminal amino acids
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSGSPKKKRKVDGSPKKKRKVDSG

SEQ ID NO: 26 - RNA, 4179 nt, Artificial Sequence
  Synthetic: Cas9 nickase mRNA ORF encoding SEQ ID NO: 25 using minimal uridine codons as listed in Table 3, with start and stop codons
auggacaagaaguacagcaucggacuggcaaucggaacaaacagcgucggaugggcagucaucacagacgaauacaaggucccgagcaagaaguucaagguccugggaaacacagacagacacagcaucaagaagaaccugaucggagcacugcuguucgacagcggagaaacagcagaagcaacaagacugaagagaacagcaagaagaagauacacaagaagaaagaacagaaucugcuaccugcaggaaaucuucagcaacgaaauggcaaaggucgacgacagcuucuuccacagacuggaagaaagcuuccuggucgaagaagacaagaagcacgaaagacacccgaucuucggaaacaucgucgacgaagucgcauaccacgaaaaguacccgacaaucuaccaccugagaaagaagcuggucgacagcacagacaaggcagaccugagacugaucuaccuggcacuggcacacaugaucaaguucagaggacacuuccugaucgaaggagaccugaacccggacaacagcgacgucgacaagcuguucauccagcugguccagacauacaaccagcuguucgaagaaaacccgaucaacgcaagcggagucgacgcaaaggcaauccugagcgcaagacugagcaagagcagaagacuggaaaaccugaucgcacagcugccgggagaaaagaagaacggacuguucggaaaccugaucgcacugagccugggacugacaccgaacuucaagagcaacuucgaccuggcagaagacgcaaagcugcagcugagcaaggacacauacgacgacgaccuggacaaccugcuggcacagaucggagaccaguacgcagaccuguuccuggcagcaaagaaccugagcgacgcaauccugcugagcgacauccugagagucaacacagaaaucacaaaggcaccgcugagcgcaagcaugaucaagagauacgacgaacaccaccaggaccugacacugcugaaggcacuggucagacagcagcugccggaaaaguacaaggaaaucuucuucgaccagagcaagaacggauacgcaggauacaucgacggaggagcaagccaggaagaauucuacaaguucaucaagccgauccuggaaaagauggacggaacagaagaacugcuggucaagcugaacagagaagaccugcugagaaagcagagaacauucgacaacggaagcaucccgcaccagauccaccugggagaacugcacgcaauccugagaagacaggaagacuucuacccguuccugaaggacaacagagaaaagaucgaaaagauccugacauucagaaucccguacuacgucggaccgcuggcaagaggaaacagcagauucgcauggaugacaagaaagagcgaagaaacaaucacaccguggaacuucgaagaagucgucgacaagggagcaagcgcacagagcuucaucgaaagaaugacaaacuucgacaagaaccugccgaacgaaaagguccugccgaagcacagccugcuguacgaauacuucacagucuacaacgaacugacaaaggucaaguacgucacagaaggaaugagaaagccggcauuccugagcggagaacagaagaaggcaaucgucgaccugcuguucaagacaaacagaaaggucacagucaagcagcugaaggaagacuacuucaagaagaucgaaugcuucgacagcgucgaaaucagcggagucgaagacagauucaacgcaagccugggaacauaccacgaccugcugaagaucaucaaggacaaggacuuccuggacaacgaagaaaacgaagacauccuggaagacaucguccugacacugacacuguucgaagacagagaaaugaucgaagaaagacugaagacauacgcacaccuguucgacgacaaggucaugaagcagcugaagagaagaagauacacaggauggggaagacugagcagaaagcugaucaacggaaucagagacaagcagagcggaaagacaauccuggacuuccugaagagcgacggauucgcaaacagaaacuucaugcagcugauccacgacgacagccugacauucaaggaagacauccagaaggcacaggucagcggacagggagacagccugcacgaacacaucgcaaaccuggcaggaagcccggcaaucaagaagggaauccugcagacagucaaggucgucgacgaacuggucaaggucaugggaagacacaagccggaaaacaucgucaucgaaauggcaagagaaaaccagacaacacagaagggacagaagaacagcagagaaagaaugaagagaaucgaagaaggaaucaaggaacugggaagccagauccugaaggaacacccggucgaaaacacacagcugcagaacgaaaagcuguaccuguacuaccugcagaacggaagagacauguacgucgaccaggaacuggacaucaacagacugagcgacuacgacgucgaccacaucgucccgcagagcuuccugaaggacgacagcaucgacaacaagguccugacaagaagcgacaagaacagaggaaagagcgacaacgucccgagcgaagaagucgucaagaagaugaagaacuacuggagacagcugcugaacgcaaagcugaucacacagagaaaguucgacaaccugacaaaggcagagagaggaggacugagcgaacuggacaaggcaggauucaucaagagacagcuggucgaaacaagacagaucacaaagcacgucgcacagauccuggacagcagaaugaacacaaaguacgacgaaaacgacaagcugaucagagaagucaaggucaucacacugaagagcaagcuggucagcgacuucagaaaggacuuccaguucuacaaggucagagaaaucaacaacuaccaccacgcacacgacgcauaccugaacgcagucgucggaacagcacugaucaagaaguacccgaagcuggaaagcgaauucgucuacggagacuacaaggucuacgacgucagaaagaugaucgcaaagagcgaacaggaaaucggaaaggcaacagcaaaguacuucuucuacagcaacaucaugaacuucuucaagacagaaaucacacuggcaaacggagaaaucagaaagagaccgcugaucgaaacaaacggagaaacaggagaaaucgucugggacaagggaagagacuucgcaacagucagaaagguccugagcaugccgcaggucaacaucgucaagaagacagaaguccagacaggaggauucagcaaggaaagcauccugccgaagagaaacagcgacaagcugaucgcaagaaagaaggacugggacccgaagaaguacggaggauucgacagcccgacagucgcauacagcguccuggucgucgcaaaggucgaaaagggaaagagcaagaagcugaagagcgucaaggaacugcugggaaucacaaucauggaaagaagcagcuucgaaaagaacccgaucgacuuccuggaagcaaagggauacaaggaagucaagaaggaccugaucaucaagcugccgaaguacagccuguucgaacuggaaaacggaagaaagagaaugcuggcaagcgcaggagaacugcagaagggaaacgaacuggcacugccgagcaaguacgucaacuuccuguaccuggcaagccacuacgaaaagcugaagggaagcccggaagacaacgaacagaagcagcuguucgucgaacagcacaagcacuaccuggacgaaaucaucgaacagaucagcgaauucagcaagagagucauccuggcagacgcaaaccuggacaagguccugagcgcauacaacaagcacagagacaagccgaucagagaacaggcagaaaacaucauccaccuguucacacugacaaaccugggagcaccggcagcauucaaguacuucgacacaacaaucgacagaaagagauacacaagcacaaaggaaguccuggacgcaacacugauccaccagagcaucacaggacuguacgaaacaagaaucgaccugagccagcugggaggagacggaagcggaagcccgaagaagaagagaaaggucgacggaagcccgaagaagaagagaaaggucgacagcggauag

SEQ ID NO: 27 - RNA, 4173 nt, Artificial Sequence
  Synthetic: Cas9 nickase coding sequence encoding SEQ ID NO: 25 using minimal uridine codons as listed in Table 3 (no start or stop codons; suitable for inclusion in fusion protein coding sequence)
gacaagaaguacagcaucggacuggcaaucggaacaaacagcgucggaugggcagucaucacagacgaauacaaggucccgagcaagaaguucaagguccugggaaacacagacagacacagcaucaagaagaaccugaucggagcacugcuguucgacagcggagaaacagcagaagcaacaagacugaagagaacagcaagaagaagauacacaagaagaaagaacagaaucugcuaccugcaggaaaucuucagcaacgaaauggcaaaggucgacgacagcuucuuccacagacuggaagaaagcuuccuggucgaagaagacaagaagcacgaaagacacccgaucuucggaaacaucgucgacgaagucgcauaccacgaaaaguacccgacaaucuaccaccugagaaagaagcuggucgacagcacagacaaggcagaccugagacugaucuaccuggcacuggcacacaugaucaaguucagaggacacuuccugaucgaaggagaccugaacccggacaacagcgacgucgacaagcuguucauccagcugguccagacauacaaccagcuguucgaagaaaacccgaucaacgcaagcggagucgacgcaaaggcaauccugagcgcaagacugagcaagagcagaagacuggaaaaccugaucgcacagcugccgggagaaaagaagaacggacuguucggaaaccugaucgcacugagccugggacugacaccgaacuucaagagcaacuucgaccuggcagaagacgcaaagcugcagcugagcaaggacacauacgacgacgaccuggacaaccugcuggcacagaucggagaccaguacgcagaccuguuccuggcagcaaagaaccugagcgacgcaauccugcugagcgacauccugagagucaacacagaaaucacaaaggcaccgcugagcgcaagcaugaucaagagauacgacgaacaccaccaggaccugacacugcugaaggcacuggucagacagcagcugccggaaaaguacaaggaaaucuucuucgaccagagcaagaacggauacgcaggauacaucgacggaggagcaagccaggaagaauucuacaaguucaucaagccgauccuggaaaagauggacggaacagaagaacugcuggucaagcugaacagagaagaccugcugagaaagcagagaacauucgacaacggaagcaucccgcaccagauccaccugggagaacugcacgcaauccugagaagacaggaagacuucuacccguuccugaaggacaacagagaaaagaucgaaaagauccugacauucagaaucccguacuacgucggaccgcuggcaagaggaaacagcagauucgcauggaugacaagaaagagcgaagaaacaaucacaccguggaacuucgaagaagucgucgacaagggagcaagcgcacagagcuucaucgaaagaaugacaaacuucgacaagaaccugccgaacgaaaagguccugccgaagcacagccugcuguacgaauacuucacagucuacaacgaacugacaaaggucaaguacgucacagaaggaaugagaaagccggcauuccugagcggagaacagaagaaggcaaucgucgaccugcuguucaagacaaacagaaaggucacagucaagcagcugaaggaagacuacuucaagaagaucgaaugcuucgacagcgucgaaaucagcggagucgaagacagauucaacgcaagccugggaacauaccacgaccugcugaagaucaucaaggacaaggacuuccuggacaacgaagaaaacgaagacauccuggaagacaucguccugacacugacacuguucgaagacagagaaaugaucgaagaaagacugaagacauacgcacaccuguucgacgacaaggucaugaagcagcugaagagaagaagauacacaggauggggaagacugagcagaaagcugaucaacggaaucagagacaagcagagcggaaagacaauccuggacuuccugaagagcgacggauucgcaaacagaaacuucaugcagcugauccacgacgacagccugacauucaaggaagacauccagaaggcacaggucagcggacagggagacagccugcacgaacacaucgcaaaccuggcaggaagcccggcaaucaagaagggaauccugcagacagucaaggucgucgacgaacuggucaaggucaugggaagacacaagccggaaaacaucgucaucgaaauggcaagagaaaaccagacaacacagaagggacagaagaacagcagagaaagaaugaagagaaucgaagaaggaaucaaggaacugggaagccagauccugaaggaacacccggucgaaaacacacagcugcagaacgaaaagcuguaccuguacuaccugcagaacggaagagacauguacgucgaccaggaacuggacaucaacagacugagcgacuacgacgucgaccacaucgucccgcagagcuuccugaaggacgacagcaucgacaacaagguccugacaagaagcgacaagaacagaggaaagagcgacaacgucccgagcgaagaagucgucaagaagaugaagaacuacuggagacagcugcugaacgcaaagcugaucacacagagaaaguucgacaaccugacaaaggcagagagaggaggacugagcgaacuggacaaggcaggauucaucaagagacagcuggucgaaacaagacagaucacaaagcacgucgcacagauccuggacagcagaaugaacacaaaguacgacgaaaacgacaagcugaucagagaagucaaggucaucacacugaagagcaagcuggucagcgacuucagaaaggacuuccaguucuacaaggucagagaaaucaacaacuaccaccacgcacacgacgcauaccugaacgcagucgucggaacagcacugaucaagaaguacccgaagcuggaaagcgaauucgucuacggagacuacaaggucuacgacgucagaaagaugaucgcaaagagcgaacaggaaaucggaaaggcaacagcaaaguacuucuucuacagcaacaucaugaacuucuucaagacagaaaucacacuggcaaacggagaaaucagaaagagaccgcugaucgaaacaaacggagaaacaggagaaaucgucugggacaagggaagagacuucgcaacagucagaaagguccugagcaugccgcaggucaacaucgucaagaagacagaaguccagacaggaggauucagcaaggaaagcauccugccgaagagaaacagcgacaagcugaucgcaagaaagaaggacugggacccgaagaaguacggaggauucgacagcccgacagucgcauacagcguccuggucgucgcaaaggucgaaaagggaaagagcaagaagcugaagagcgucaaggaacugcugggaaucacaaucauggaaagaagcagcuucgaaaagaacccgaucgacuuccuggaagcaaagggauacaaggaagucaagaaggaccugaucaucaagcugccgaaguacagccuguucgaacuggaaaacggaagaaagagaaugcuggcaagcgcaggagaacugcagaagggaaacgaacuggcacugccgagcaaguacgucaacuuccuguaccuggcaagccacuacgaaaagcugaagggaagcccggaagacaacgaacagaagcagcuguucgucgaacagcacaagcacuaccuggacgaaaucaucgaacagaucagcgaauucagcaagagagucauccuggcagacgcaaaccuggacaagguccugagcgcauacaacaagcacagagacaagccgaucagagaacaggcagaaaacaucauccaccuguucacacugacaaaccugggagcaccggcagcauucaaguacuucgacacaacaaucgacagaaagagauacacaagcacaaaggaaguccuggacgcaacacugauccaccagagcaucacaggacuguacgaaacaagaaucgaccugagccagcugggaggagacggaagcggaagcccgaagaagaagagaaaggucgacggaagcccgaagaagaagagaaaggucgacagcgga

SEQ ID NO: 28 - protein, 1392 aa, Artificial Sequence
  Synthetic: Amino acid sequence of dCas9 with two nuclear localization signals as the C-terminal amino acids
MDKKYSIGLAIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGSGSPKKKRKVDGSPKKKRKVDSG

SEQ ID NO: 29 - RNA, 4179 nt, Artificial Sequence
  Synthetic: dCas9 mRNA ORF encoding SEQ ID NO: 28 using minimal uridine codons as listed in Table 3, with start and stop codons
auggacaagaaguacagcaucggacuggcaaucggaacaaacagcgucggaugggcagucaucacagacgaauacaaggucccgagcaagaaguucaagguccugggaaacacagacagacacagcaucaagaagaaccugaucggagcacugcuguucgacagcggagaaacagcagaagcaacaagacugaagagaacagcaagaagaagauacacaagaagaaagaacagaaucugcuaccugcaggaaaucuucagcaacgaaauggcaaaggucgacgacagcuucuuccacagacuggaagaaagcuuccuggucgaagaagacaagaagcacgaaagacacccgaucuucggaaacaucgucgacgaagucgcauaccacgaaaaguacccgacaaucuaccaccugagaaagaagcuggucgacagcacagacaaggcagaccugagacugaucuaccuggcacuggcacacaugaucaaguucagaggacacuuccugaucgaaggagaccugaacccggacaacagcgacgucgacaagcuguucauccagcugguccagacauacaaccagcuguucgaagaaaacccgaucaacgcaagcggagucgacgcaaaggcaauccugagcgcaagacugagcaagagcagaagacuggaaaaccugaucgcacagcugccgggagaaaagaagaacggacuguucggaaaccugaucgcacugagccugggacugacaccgaacuucaagagcaacuucgaccuggcagaagacgcaaagcugcagcugagcaaggacacauacgacgacgaccuggacaaccugcuggcacagaucggagaccaguacgcagaccuguuccuggcagcaaagaaccugagcgacgcaauccugcugagcgacauccugagagucaacacagaaaucacaaaggcaccgcugagcgcaagcaugaucaagagauacgacgaacaccaccaggaccugacacugcugaaggcacuggucagacagcagcugccggaaaaguacaaggaaaucuucuucgaccagagcaagaacggauacgcaggauacaucgacggaggagcaagccaggaagaauucuacaaguucaucaagccgauccuggaaaagauggacggaacagaagaacugcuggucaagcugaacagagaagaccugcugagaaagcagagaacauucgacaacggaagcaucccgcaccagauccaccugggagaacugcacgcaauccugagaagacaggaagacuucuacccguuccugaaggacaacagagaaaagaucgaaaagauccugacauucagaaucccguacuacgucggaccgcuggcaagaggaaacagcagauucgcauggaugacaagaaagagcgaagaaacaaucacaccguggaacuucgaagaagucgucgacaagggagcaagcgcacagagcuucaucgaaagaaugacaaacuucgacaagaaccugccgaacgaaaagguccugccgaagcacagccugcuguacgaauacuucacagucuacaacgaacugacaaaggucaaguacgucacagaaggaaugagaaagccggcauuccugagcggagaacagaagaaggcaaucgucgaccugcuguucaagacaaacagaaaggucacagucaagcagcugaaggaagacuacuucaagaagaucgaaugcuucgacagcgucgaaaucagcggagucgaagacagauucaacgcaagccugggaacauaccacgaccugcugaagaucaucaaggacaaggacuuccuggacaacgaagaaaacgaagacauccuggaagacaucguccugacacugacacuguucgaagacagagaaaugaucgaagaaagacugaagacauacgcacaccuguucgacgacaaggucaugaagcagcugaagagaagaagauacacaggauggggaagacugagcagaaagcugaucaacggaaucagagacaagcagagcggaaagacaauccuggacuuccugaagagcgacggauucgcaaacagaaacuucaugcagcugauccacgacgacagccugacauucaaggaagacauccagaaggcacaggucagcggacagggagacagccugcacgaacacaucgcaaaccuggcaggaagcccggcaaucaagaagggaauccugcagacagucaaggucgucgacgaacuggucaaggucaugggaagacacaagccggaaaacaucgucaucgaaauggcaagagaaaaccagacaacacagaagggacagaagaacagcagagaaagaaugaagagaaucgaagaaggaaucaaggaacugggaagccagauccugaaggaacacccggucgaaaacacacagcugcagaacgaaaagcuguaccuguacuaccugcagaacggaagagacauguacgucgaccaggaacuggacaucaacagacugagcgacuacgacgucgacgcaaucgucccgcagagcuuccugaaggacgacagcaucgacaacaagguccugacaagaagcgacaagaacagaggaaagagcgacaacgucccgagcgaagaagucgucaagaagaugaagaacuacuggagacagcugcugaacgcaaagcugaucacacagagaaaguucgacaaccugacaaaggcagagagaggaggacugagcgaacuggacaaggcaggauucaucaagagacagcuggucgaaacaagacagaucacaaagcacgucgcacagauccuggacagcagaaugaacacaaaguacgacgaaaacgacaagcugaucagagaagucaaggucaucacacugaagagcaagcuggucagcgacuucagaaaggacuuccaguucuacaaggucagagaaaucaacaacuaccaccacgcacacgacgcauaccugaacgcagucgucggaacagcacugaucaagaaguacccgaagcuggaaagcgaauucgucuacggagacuacaaggucuacgacgucagaaagaugaucgcaaagagcgaacaggaaaucggaaaggcaacagcaaaguacuucuucuacagcaacaucaugaacuucuucaagacagaaaucacacuggcaaacggagaaaucagaaagagaccgcugaucgaaacaaacggagaaacaggagaaaucgucugggacaagggaagagacuucgcaacagucagaaagguccugagcaugccgcaggucaacaucgucaagaagacagaaguccagacaggaggauucagcaaggaaagcauccugccgaagagaaacagcgacaagcugaucgcaagaaagaaggacugggacccgaagaaguacggaggauucgacagcccgacagucgcauacagcguccuggucgucgcaaaggucgaaaagggaaagagcaagaagcugaagagcgucaaggaacugcugggaaucacaaucauggaaagaagcagcuucgaaaagaacccgaucgacuuccuggaagcaaagggauacaaggaagucaagaaggaccugaucaucaagcugccgaaguacagccuguucgaacuggaaaacggaagaaagagaaugcuggcaagcgcaggagaacugcagaagggaaacgaacuggcacugccgagcaaguacgucaacuuccuguaccuggcaagccacuacgaaaagcugaagggaagcccggaagacaacgaacagaagcagcuguucgucgaacagcacaagcacuaccuggacgaaaucaucgaacagaucagcgaauucagcaagagagucauccuggcagacgcaaaccuggacaagguccugagcgcauacaacaagcacagagacaagccgaucagagaacaggcagaaaacaucauccaccuguucacacugacaaaccugggagcaccggcagcauucaaguacuucgacacaacaaucgacagaaagagauacacaagcacaaaggaaguccuggacgcaacacugauccaccagagcaucacaggacuguacgaaacaagaaucgaccugagccagcugggaggagacggaagcggaagcccgaagaagaagagaaaggucgacggaagcccgaagaagaagagaaaggucgacagcggauag

SEQ ID NO: 30 - RNA, 4173 nt, Artificial Sequence
  Synthetic: dCas9 coding sequence encoding SEQ ID NO: 28 using minimal uridine codons as listed in Table 3 (no start or stop codons; suitable for inclusion in fusion protein coding sequence)
gacaagaaguacagcaucggacuggcaaucggaacaaacagcgucggaugggcagucaucacagacgaauacaaggucccgagcaagaaguucaagguccugggaaacacagacagacacagcaucaagaagaaccugaucggagcacugcuguucgacagcggagaaacagcagaagcaacaagacugaagagaacagcaagaagaagauacacaagaagaaagaacagaaucugcuaccugcaggaaaucuucagcaacgaaauggcaaaggucgacgacagcuucuuccacagacuggaagaaagcuuccuggucgaagaagacaagaagcacgaaagacacccgaucuucggaaacaucgucgacgaagucgcauaccacgaaaaguacccgacaaucuaccaccugagaaagaagcuggucgacagcacagacaaggcagaccugagacugaucuaccuggcacuggcacacaugaucaaguucagaggacacuuccugaucgaaggagaccugaacccggacaacagcgacgucgacaagcuguucauccagcugguccagacauacaaccagcuguucgaagaaaacccgaucaacgcaagcggagucgacgcaaaggcaauccugagcgcaagacugagcaagagcagaagacuggaaaaccugaucgcacagcugccgggagaaaagaagaacggacuguucggaaaccugaucgcacugagccugggacugacaccgaacuucaagagcaacuucgaccuggcagaagacgcaaagcugcagcugagcaaggacacauacgacgacgaccuggacaaccugcuggcacagaucggagaccaguacgcagaccuguuccuggcagcaaagaaccugagcgacgcaauccugcugagcgacauccugagagucaacacagaaaucacaaaggcaccgcugagcgcaagcaugaucaagagauacgacgaacaccaccaggaccugacacugcugaaggcacuggucagacagcagcugccggaaaaguacaaggaaaucuucuucgaccagagcaagaacggauacgcaggauacaucgacggaggagcaagccaggaagaauucuacaaguucaucaagccgauccuggaaaagauggacggaacagaagaacugcuggucaagcugaacagagaagaccugcugagaaagcagagaacauucgacaacggaagcaucccgcaccagauccaccugggagaacugcacgcaauccugagaagacaggaagacuucuacccguuccugaaggacaacagagaaaagaucgaaaagauccugacauucagaaucccguacuacgucggaccgcuggcaagaggaaacagcagauucgcauggaugacaagaaagagcgaagaaacaaucacaccguggaacuucgaagaagucgucgacaagggagcaagcgcacagagcuucaucgaaagaaugacaaacuucgacaagaaccugccgaacgaaaagguccugccgaagcacagccugcuguacgaauacuucacagucuacaacgaacugacaaaggucaaguacgucacagaaggaaugagaaagccggcauuccugagcggagaacagaagaaggcaaucgucgaccugcuguucaagacaaacagaaaggucacagucaagcagcugaaggaagacuacuucaagaagaucgaaugcuucgacagcgucgaaaucagcggagucgaagacagauucaacgcaagccugggaacauaccacgaccugcugaagaucaucaaggacaaggacuuccuggacaacgaagaaaacgaagacauccuggaagacaucguccugacacugacacuguucgaagacagagaaaugaucgaagaaagacugaagacauacgcacaccuguucgacgacaaggucaugaagcagcugaagagaagaagauacacaggauggggaagacugagcagaaagcugaucaacggaaucagagacaagcagagcggaaagacaauccuggacuuccugaagagcgacggauucgcaaacagaaacuucaugcagcugauccacgacgacagccugacauucaaggaagacauccagaaggcacaggucagcggacagggagacagccugcacgaacacaucgcaaaccuggcaggaagcccggcaaucaagaagggaauccugcagacagucaaggucgucgacgaacuggucaaggucaugggaagacacaagccggaaaacaucgucaucgaaauggcaagagaaaaccagacaacacagaagggacagaagaacagcagagaaagaaugaagagaaucgaagaaggaaucaaggaacugggaagccagauccugaaggaacacccggucgaaaacacacagcugcagaacgaaaagcuguaccuguacuaccugcagaacggaagagacauguacgucgaccaggaacuggacaucaacagacugagcgacuacgacgucgacgcaaucgucccgcagagcuuccugaaggacgacagcaucgacaacaagguccugacaagaagcgacaagaacagaggaaagagcgacaacgucccgagcgaagaagucgucaagaagaugaagaacuacuggagacagcugcugaacgcaaagcugaucacacagagaaaguucgacaaccugacaaaggcagagagaggaggacugagcgaacuggacaaggcaggauucaucaagagacagcuggucgaaacaagacagaucacaaagcacgucgcacagauccuggacagcagaaugaacacaaaguacgacgaaaacgacaagcugaucagagaagucaaggucaucacacugaagagcaagcuggucagcgacuucagaaaggacuuccaguucuacaaggucagagaaaucaacaacuaccaccacgcacacgacgcauaccugaacgcagucgucggaacagcacugaucaagaaguacccgaagcuggaaagcgaauucgucuacggagacuacaaggucuacgacgucagaaagaugaucgcaaagagcgaacaggaaaucggaaaggcaacagcaaaguacuucuucuacagcaacaucaugaacuucuucaagacagaaaucacacuggcaaacggagaaaucagaaagagaccgcugaucgaaacaaacggagaaacaggagaaaucgucugggacaagggaagagacuucgcaacagucagaaagguccugagcaugccgcaggucaacaucgucaagaagacagaaguccagacaggaggauucagcaaggaaagcauccugccgaagagaaacagcgacaagcugaucgcaagaaagaaggacugggacccgaagaaguacggaggauucgacagcccgacagucgcauacagcguccuggucgucgcaaaggucgaaaagggaaagagcaagaagcugaagagcgucaaggaacugcugggaaucacaaucauggaaagaagcagcuucgaaaagaacccgaucgacuuccuggaagcaaagggauacaaggaagucaagaaggaccugaucaucaagcugccgaaguacagccuguucgaacuggaaaacggaagaaagagaaugcuggcaagcgcaggagaacugcagaagggaaacgaacuggcacugccgagcaaguacgucaacuuccuguaccuggcaagccacuacgaaaagcugaagggaagcccggaagacaacgaacagaagcagcuguucgucgaacagcacaagcacuaccuggacgaaaucaucgaacagaucagcgaauucagcaagagagucauccuggcagacgcaaaccuggacaagguccugagcgcauacaacaagcacagagacaagccgaucagagaacaggcagaaaacaucauccaccuguucacacugacaaaccugggagcaccggcagcauucaaguacuucgacacaacaaucgacagaaagagauacacaagcacaaaggaaguccuggacgcaacacugauccaccagagcaucacaggacuguacgaaacaagaaucgaccugagccagcugggaggagacggaagcggaagcccgaagaagaagagaaaggucgacggaagcccgaagaagaagagaaaggucgacagcgga

SEQ ID NO: 31 - DNA, 17 bp, Artificial Sequence
  Synthetic: T7 promoter
taatacgactcactata

SEQ ID NO: 32 - DNA, 50 bp, Homo sapiens
  misc_feature (1)..(50): Human beta-globin 5 UTR
acatttgcttctgacacaactgtgttcactagcaacctcaaacagacacc

SEQ ID NO: 33 - DNA, 132 bp, Homo sapiens
  misc_feature (1)..(132): Human beta-globin 3 UTR
gctcgctttcttgctgtccaatttctattaaaggttcctttgttccctaagtccaactactaaactgggggatattatgaagggccttgagcatctggattctgcctaataaaaaacatttattttcattgc

SEQ ID NO: 34 - DNA, 66 bp, Homo sapiens
  misc_feature (1)..(66): Human alpha-globin 5 UTR
cataaaccctggcgcgctcgcggcccggcactcttctggtccccacagactcagagagaacccacc

SEQ ID NO: 35 - DNA, 110 bp, Homo sapiens
  misc_feature (1)..(110): Human alpha-globin 3 UTR
gctggagcctcggtggccatgcttcttgccccttgggcctccccccagcccctcctccccttcctgcacccgtacccccgtggtctttgaataaagtctgagtgggcggc

SEQ ID NO: 36 - DNA, 29 bp, Xenopus laevis
  misc_feature (1)..(29): Xenopus laevis beta-globin 5 UTR
aagctcagaataaacgctcaactttggcc

SEQ ID NO: 37 - DNA, 130 bp, Xenopus laevis
  misc_feature (1)..(130): Xenopus laevis beta-globin 3 UTR
accagcctcaagaacacccgaatggagtctctaagctacataataccaacttacactttacaaaatgttgtcccccaaaatgtagccattcgtatctgctcctaataaaaagaaagtttcttcacattct

SEQ ID NO: 38 - DNA, 27 bp, Bos taurus
  misc_feature (1)..(27): Bovine Growth Hormone 5 UTR
cagggtcctgtggacagctcaccagct

SEQ ID NO: 39 - DNA, 102 bp, Bos taurus
  misc_feature (1)..(102): Bovine Growth Hormone 3 UTR
ttgccagccatctgttgtttgcccctcccccgtgccttccttgaccctggaaggtgccactcccactgtcctttcctaataaaatgaggaaattgcatcgca

SEQ ID NO: 40 - DNA, 93 bp, Mus musculus
  misc_feature (1)..(93): Mus musculus hemoglobin alpha, adult chain 1 (Hba-a1), 3UTR
gctgccttctgcggggcttgccttctggccatgcccttcttctctcccttgcacctgtacctcttggtctttgaataaagcctgagtaggaag

SEQ ID NO: 41 - DNA, 61 bp, Artificial Sequence
  Synthetic: HSD17B4 5 UTR
tcccgcagtcggcgtccagcggctctgcttgttcgtgtgtgtgtcgttgcaggccttattc

SEQ ID NO: 42 - RNA, 100 nt, Artificial Sequence
  Synthetic: G282 guide RNA targeting TTR
  modified_base (1)..(3): PS linkage, 2'-O-Me nucleotide
  modified_base (29)..(40): 2'-O-Me nucleotide
  modified_base (69)..(96): 2'-O-Me nucleotide
  modified_base (97)..(100): PS linkage, 2'-O-Me nucleotide
uuacagccacgucuacagcaguuuuagagcuagaaauagcaaguuaaaauaaggcuaguccguuaucaacuugaaaaaguggcaccgagucggugcuuuu

SEQ ID NO: 43 - DNA, 4411 bp, Artificial Sequence
  Synthetic: Cas9 transcript with 5 UTR of HSD, ORF corresponding to SEQ ID NO: 4, Kozak sequence, and 3 UTR of ALB
gggtcccgcagtcggcgtccagcggctctgcttgttcgtgtgtgtgtcgttgcaggccttattcggatccgccaccatggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcccgaagaagaagagaaaggtctagctagccatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctcgag

SEQ ID NO: 44 - DNA, 4405 bp, Artificial Sequence
  Synthetic: Cas9 transcript with 5 UTR of HSD, ORF corresponding to SEQ ID NO: 4, and 3 UTR of ALB
gggtcccgcagtcggcgtccagcggctctgcttgttcgtgtgtgtgtcgttgcaggccttattcggatccatggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcccgaagaagaagagaaaggtctagctagccatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctcgag

SEQ ID NO: 45 - DNA, 4188 bp, Artificial Sequence
  Synthetic: Alternative Cas9 ORF with 19.36% U content
atggataagaagtactcgatcgggctggatatcggaactaattccgtgggttgggcagtgatcacggatgaatacaaagtgccgtccaagaagttcaaggtcctggggaacaccgatagacacagcatcaagaagaatctcatcggagccctgctgtttgactccggcgaaaccgcagaagcgacccggctcaaacgtaccgcgaggcgacgctacacccggcggaagaatcgcatctgctatctgcaagaaatcttttcgaacgaaatggcaaaggtggacgacagcttcttccaccgcctggaagaatctttcctggtggaggaggacaagaagcatgaacggcatcctatctttggaaacatcgtggacgaagtggcgtaccacgaaaagtacccgaccatctaccatctgcggaagaagttggttgactcaactgacaaggccgacctcagattgatctacttggccctcgcccatatgatcaaattccgcggacacttcctgatcgaaggcgatctgaaccctgataactccgacgtggataagctgttcattcaactggtgcagacctacaaccaactgttcgaagaaaacccaatcaatgccagcggcgtcgatgccaaggccatcctgtccgcccggctgtcgaagtcgcggcgcctcgaaaacctgatcgcacagctgccgggagagaagaagaacggacttttcggcaacttgatcgctctctcactgggactcactcccaatttcaagtccaattttgacctggccgaggacgcgaagctgcaactctcaaaggacacctacgacgacgacttggacaatttgctggcacaaattggcgatcagtacgcggatctgttccttgccgctaagaacctttcggacgcaatcttgctgtccgatatcctgcgcgtgaacaccgaaataaccaaagcgccgcttagcgcctcgatgattaagcggtacgacgagcatcaccaggatctcacgctgctcaaagcgctcgtgagacagcaactgcctgaaaagtacaaggagattttcttcgaccagtccaagaatgggtacgcagggtacatcgatggaggcgccagccaggaagagttctataagttcatcaagccaatcctggaaaagatggacggaaccgaagaactgctggtcaagctgaacagggaggatctgctccgcaaacagagaacctttgacaacggaagcattccacaccagatccatctgggtgagctgcacgccatcttgcggcgccaggaggacttttacccattcctcaaggacaaccgggaaaagatcgagaaaattctgacgttccgcatcccgtattacgtgggcccactggcgcgcggcaattcgcgcttcgcgtggatgactagaaaatcagaggaaaccatcactccttggaatttcgaggaagttgtggataagggagcttcggcacaatccttcatcgaacgaatgaccaacttcgacaagaatctcccaaacgagaaggtgcttcctaagcacagcctcctttacgaatacttcactgtctacaacgaactgactaaagtgaaatacgttactgaaggaatgaggaagccggcctttctgagcggagaacagaagaaagcgattgtcgatctgctgttcaagaccaaccgcaaggtgaccgtcaagcagcttaaagaggactacttcaagaagatcgagtgtttcgactcagtggaaatcagcggagtggaggacagattcaacgcttcgctgggaacctatcatgatctcctgaagatcatcaaggacaaggacttccttgacaacgaggagaacgaggacatcctggaagatatcgtcctgaccttgacccttttcgaggatcgcgagatgatcgaggagaggcttaagacctacgctcatctcttcgacgataaggtcatgaaacaactcaagcgccgccggtacactggttggggccgcctctcccgcaagctgatcaacggtattcgcgataaacagagcggtaaaactatcctggatttcctcaaatcggatggcttcgctaatcgtaacttcatgcagttgatccacgacgacagcctgacctttaaggaggacatccagaaagcacaagtgagcggacagggagactcactccatgaacacatcgcgaatctggccggttcgccggcgattaagaagggaatcctgcaaactgtgaaggtggtggacgagctggtgaaggtcatgggacggcacaaaccggagaatatcgtgattgaaatggcccgagaaaaccagactacccagaagggccagaagaactcccgcgaaaggatgaagcggatcgaagaaggaatcaaggagctgggcagccagatcctgaaagagcacccggtggaaaacacgcagctgcagaacgagaagctctacctgtactatttgcaaaatggacgggacatgtacgtggaccaagagctggacatcaatcggttgtctgattacgacgtggaccacatcgttccacagtcctttctgaaggatgactccatcgataacaaggtgttgactcgcagcgacaagaacagagggaagtcagataatgtgccatcggaggaggtcgtgaagaagatgaagaattactggcggcagctcctgaatgcgaagctgattacccagagaaagtttgacaatctcactaaagccgagcgcggcggactctcagagctggataaggctggattcatcaaacggcagctggtcgagactcggcagattaccaagcacgtggcgcagatcctggactcccgcatgaacactaaatacgacgagaacgataagctcatccgggaagtgaaggtgattaccctgaaaagcaaacttgtgtcggactttcggaaggactttcagttttacaaagtgagagaaatcaacaactaccatcacgcgcatgacgcatacctcaacgctgtggtcggcaccgccctgatcaagaagtaccctaaacttgaatcggagtttgtgtacggagactacaaggtctacgacgtgaggaagatgatagccaagtccgaacaggaaatcgggaaagcaactgcgaaatacttcttttactcaaacatcatgaacttcttcaagactgaaattacgctggccaatggagaaatcaggaagaggccactgatcgaaactaacggagaaacgggcgaaatcgtgtgggacaagggcagggacttcgcaactgttcgcaaagtgctctctatgccgcaagtcaatattgtgaagaaaaccgaagtgcaaaccggcggattttcaaaggaatcgatcctcccaaagagaaatagcgacaagctcattgcacgcaagaaagactgggacccgaagaagtacggaggattcgattcgccgactgtcgcatactccgtcctcgtggtggccaaggtggagaagggaaagagcaagaagctcaaatccgtcaaagagctgctggggattaccatcatggaacgatcctcgttcgagaagaacccgattgatttcctggaggcgaagggttacaaggaggtgaagaaggatctgatcatcaaactgcccaagtactcactgttcgaactggaaaatggtcggaagcgcatgctggcttcggccggagaactccagaaaggaaatgagctggccttgcctagcaagtacgtcaacttcctctatcttgcttcgcactacgagaaactcaaagggtcaccggaagataacgaacagaagcagcttttcgtggagcagcacaagcattatctggatgaaatcatcgaacaaatctccgagttttcaaagcgcgtgatcctcgccgacgccaacctcgacaaagtcctgtcggcctacaataagcatagagataagccgatcagagaacaggccgagaacattatccacttgttcaccctgactaacctgggagctccagccgccttcaagtacttcgatactactatcgaccgcaaaagatacacgtccaccaaggaagttctggacgcgaccctgatccaccaaagcatcactggactctacgaaactaggatcgatctgtcgcagctgggtggcgatggtggcggtggatcctacccatacgacgtgcctgactacgcctccggaggtggtggccccaagaagaaacggaaggtgtgatag

SEQ ID NO: 46 - DNA, 4459 bp, Artificial Sequence
  Synthetic: Cas9 transcript with 5 UTR of HSD, ORF corresponding to SEQ ID NO: 45, Kozak sequence, and 3 UTR of ALB
gggtcccgcagtcggcgtccagcggctctgcttgttcgtgtgtgtgtcgttgcaggccttattcggatctgccaccatggataagaagtactcgatcgggctggatatcggaactaattccgtgggttgggcagtgatcacggatgaatacaaagtgccgtccaagaagttcaaggtcctggggaacaccgatagacacagcatcaagaagaatctcatcggagccctgctgtttgactccggcgaaaccgcagaagcgacccggctcaaacgtaccgcgaggcgacgctacacccggcggaagaatcgcatctgctatctgcaagaaatcttttcgaacgaaatggcaaaggtggacgacagcttcttccaccgcctggaagaatctttcctggtggaggaggacaagaagcatgaacggcatcctatctttggaaacatcgtggacgaagtggcgtaccacgaaaagtacccgaccatctaccatctgcggaagaagttggttgactcaactgacaaggccgacctcagattgatctacttggccctcgcccatatgatcaaattccgcggacacttcctgatcgaaggcgatctgaaccctgataactccgacgtggataagctgttcattcaactggtgcagacctacaaccaactgttcgaagaaaacccaatcaatgccagcggcgtcgatgccaaggccatcctgtccgcccggctgtcgaagtcgcggcgcctcgaaaacctgatcgcacagctgccgggagagaagaagaacggacttttcggcaacttgatcgctctctcactgggactcactcccaatttcaagtccaattttgacctggccgaggacgcgaagctgcaactctcaaaggacacctacgacgacgacttggacaatttgctggcacaaattggcgatcagtacgcggatctgttccttgccgctaagaacctttcggacgcaatcttgctgtccgatatcctgcgcgtgaacaccgaaataaccaaagcgccgcttagcgcctcgatgattaagcggtacgacgagcatcaccaggatctcacgctgctcaaagcgctcgtgagacagcaactgcctgaaaagtacaaggagattttcttcgaccagtccaagaatgggtacgcagggtacatcgatggaggcgccagccaggaagagttctataagttcatcaagccaatcctggaaaagatggacggaaccgaagaactgctggtcaagctgaacagggaggatctgctccgcaaacagagaacctttgacaacggaagcattccacaccagatccatctgggtgagctgcacgccatcttgcggcgccaggaggacttttacccattcctcaaggacaaccgggaaaagatcgagaaaattctgacgttccgcatcccgtattacgtgggcccactggcgcgcggcaattcgcgcttcgcgtggatgactagaaaatcagaggaaaccatcactccttggaatttcgaggaagttgtggataagggagcttcggcacaatccttcatcgaacgaatgaccaacttcgacaagaatctcccaaacgagaaggtgcttcctaagcacagcctcctttacgaatacttcactgtctacaacgaactgactaaagtgaaatacgttactgaaggaatgaggaagccggcctttctgagcggagaacagaagaaagcgattgtcgatctgctgttcaagaccaaccgcaaggtgaccgtcaagcagcttaaagaggactacttcaagaagatcgagtgtttcgactcagtggaaatcagcggagtggaggacagattcaacgcttcgctgggaacctatcatgatctcctgaagatcatcaaggacaaggacttccttgacaacgaggagaacgaggacatcctggaagatatcgtcctgaccttgacccttttcgaggatcgcgagatgatcgaggagaggcttaagacctacgctcatctcttcgacgataaggtcatgaaacaactcaagcgccgccggtacactggttggggccgcctctcccgcaagctgatcaacggtattcgcgataaacagagcggtaaaactatcctggatttcctcaaatcggatggcttcgctaatcgtaacttcatgcagttgatccacgacgacagcctgacctttaaggaggacatccagaaagcacaagtgagcggacagggagactcactccatgaacacatcgcgaatctggccggttcgccggcgattaagaagggaatcctgcaaactgtgaaggtggtggacgagctggtgaaggtcatgggacggcacaaaccggagaatatcgtgattgaaatggcccgagaaaaccagactacccagaagggccagaagaactcccgcgaaaggatgaagcggatcgaagaaggaatcaaggagctgggcagccagatcctgaaagagcacccggtggaaaacacgcagctgcagaacgagaagctctacctgtactatttgcaaaatggacgggacatgtacgtggaccaagagctggacatcaatcggttgtctgattacgacgtggaccacatcgttccacagtcctttctgaaggatgactccatcgataacaaggtgttgactcgcagcgacaagaacagagggaagtcagataatgtgccatcggaggaggtcgtgaagaagatgaagaattactggcggcagctcctgaatgcgaagctgattacccagagaaagtttgacaatctcactaaagccgagcgcggcggactctcagagctggataaggctggattcatcaaacggcagctggtcgagactcggcagattaccaagcacgtggcgcagatcctggactcccgcatgaacactaaatacgacgagaacgataagctcatccgggaagtgaaggtgattaccctgaaaagcaaacttgtgtcggactttcggaaggactttcagttttacaaagtgagagaaatcaacaactaccatcacgcgcatgacgcatacctcaacgctgtggtcggcaccgccctgatcaagaagtaccctaaacttgaatcggagtttgtgtacggagactacaaggtctacgacgtgaggaagatgatagccaagtccgaacaggaaatcgggaaagcaactgcgaaatacttcttttactcaaacatcatgaacttcttcaagactgaaattacgctggccaatggagaaatcaggaagaggccactgatcgaaactaacggagaaacgggcgaaatcgtgtgggacaagggcagggacttcgcaactgttcgcaaagtgctctctatgccgcaagtcaatattgtgaagaaaaccgaagtgcaaaccggcggattttcaaaggaatcgatcctcccaaagagaaatagcgacaagctcattgcacgcaagaaagactgggacccgaagaagtacggaggattcgattcgccgactgtcgcatactccgtcctcgtggtggccaaggtggagaagggaaagagcaagaagctcaaatccgtcaaagagctgctggggattaccatcatggaacgatcctcgttcgagaagaacccgattgatttcctggaggcgaagggttacaaggaggtgaagaaggatctgatcatcaaactgcccaagtactcactgttcgaactggaaaatggtcggaagcgcatgctggcttcggccggagaactccagaaaggaaatgagctggccttgcctagcaagtacgtcaacttcctctatcttgcttcgcactacgagaaactcaaagggtcaccggaagataacgaacagaagcagcttttcgtggagcagcacaagcattatctggatgaaatcatcgaacaaatctccgagttttcaaagcgcgtgatcctcgccgacgccaacctcgacaaagtcctgtcggcctacaataagcatagagataagccgatcagagaacaggccgagaacattatccacttgttcaccctgactaacctgggagctccagccgccttcaagtacttcgatactactatcgaccgcaaaagatacacgtccaccaaggaagttctggacgcgaccctgatccaccaaagcatcactggactctacgaaactaggatcgatctgtcgcagctgggtggcgatggtggcggtggatcctacccatacgacgtgcctgactacgcctccggaggtggtggccccaagaagaaacggaaggtgtgatagctagccatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctcgag

SEQ ID NO: 47 - DNA, 4453 bp, Artificial Sequence
  Synthetic: Cas9 transcript with 5 UTR of HSD, ORF corresponding to SEQ ID NO: 45, and 3 UTR of ALB
gggtcccgcagtcggcgtccagcggctctgcttgttcgtgtgtgtgtcgttgcaggccttattcggatctatggataagaagtactcgatcgggctggatatcggaactaattccgtgggttgggcagtgatcacggatgaatacaaagtgccgtccaagaagttcaaggtcctggggaacaccgatagacacagcatcaagaagaatctcatcggagccctgctgtttgactccggcgaaaccgcagaagcgacccggctcaaacgtaccgcgaggcgacgctacacccggcggaagaatcgcatctgctatctgcaagaaatcttttcgaacgaaatggcaaaggtggacgacagcttcttccaccgcctggaagaatctttcctggtggaggaggacaagaagcatgaacggcatcctatctttggaaacatcgtggacgaagtggcgtaccacgaaaagtacccgaccatctaccatctgcggaagaagttggttgactcaactgacaaggccgacctcagattgatctacttggccctcgcccatatgatcaaattccgcggacacttcctgatcgaaggcgatctgaaccctgataactccgacgtggataagctgttcattcaactggtgcagacctacaaccaactgttcgaagaaaacccaatcaatgccagcggcgtcgatgccaaggccatcctgtccgcccggctgtcgaagtcgcggcgcctcgaaaacctgatcgcacagctgccgggagagaagaagaacggacttttcggcaacttgatcgctctctcactgggactcactcccaatttcaagtccaattttgacctggccgaggacgcgaagctgcaactctcaaaggacacctacgacgacgacttggacaatttgctggcacaaattggcgatcagtacgcggatctgttccttgccgctaagaacctttcggacgcaatcttgctgtccgatatcctgcgcgtgaacaccgaaataaccaaagcgccgcttagcgcctcgatgattaagcggtacgacgagcatcaccaggatctcacgctgctcaaagcgctcgtgagacagcaactgcctgaaaagtacaaggagattttcttcgaccagtccaagaatgggtacgcagggtacatcgatggaggcgccagccaggaagagttctataagttcatcaagccaatcctggaaaagatggacggaaccgaagaactgctggtcaagctgaacagggaggatctgctccgcaaacagagaacctttgacaacggaagcattccacaccagatccatctgggtgagctgcacgccatcttgcggcgccaggaggacttttacccattcctcaaggacaaccgggaaaagatcgagaaaattctgacgttccgcatcccgtattacgtgggcccactggcgcgcggcaattcgcgcttcgcgtggatgactagaaaatcagaggaaaccatcactccttggaatttcgaggaagttgtggataagggagcttcggcacaatccttcatcgaacgaatgaccaacttcgacaagaatctcccaaacgagaaggtgcttcctaagcacagcctcctttacgaatacttcactgtctacaacgaactgactaaagtgaaatacgttactgaaggaatgaggaagccggcctttctgagcggagaacagaagaaagcgattgtcgatctgctgttcaagaccaaccgcaaggtgaccgtcaagcagcttaaagaggactacttcaagaagatcgagtgtttcgactcagtggaaatcagcggagtggaggacagattcaacgcttcgctgggaacctatcatgatctcctgaagatcatcaaggacaaggacttccttgacaacgaggagaacgaggacatcctggaagatatcgtcctgaccttgacccttttcgaggatcgcgagatgatcgaggagaggcttaagacctacgctcatctcttcgacgataaggtcatgaaacaactcaagcgccgccggtacactggttggggccgcctctcccgcaagctgatcaacggtattcgcgataaacagagcggtaaaactatcctggatttcctcaaatcggatggcttcgctaatcgtaacttcatgcagttgatccacgacgacagcctgacctttaaggaggacatccagaaagcacaagtgagcggacagggagactcactccatgaacacatcgcgaatctggccggttcgccggcgattaagaagggaatcctgcaaactgtgaaggtggtggacgagctggtgaaggtcatgggacggcacaaaccggagaatatcgtgattgaaatggcccgagaaaaccagactacccagaagggccagaagaactcccgcgaaaggatgaagcggatcgaagaaggaatcaaggagctgggcagccagatcctgaaagagcacccggtggaaaacacgcagctgcagaacgagaagctctacctgtactatttgcaaaatggacgggacatgtacgtggaccaagagctggacatcaatcggttgtctgattacgacgtggaccacatcgttccacagtcctttctgaaggatgactccatcgataacaaggtgttgactcgcagcgacaagaacagagggaagtcagataatgtgccatcggaggaggtcgtgaagaagatgaagaattactggcggcagctcctgaatgcgaagctgattacccagagaaagtttgacaatctcactaaagccgagcgcggcggactctcagagctggataaggctggattcatcaaacggcagctggtcgagactcggcagattaccaagcacgtggcgcagatcctggactcccgcatgaacactaaatacgacgagaacgataagctcatccgggaagtgaaggtgattaccctgaaaagcaaacttgtgtcggactttcggaaggactttcagttttacaaagtgagagaaatcaacaactaccatcacgcgcatgacgcatacctcaacgctgtggtcggcaccgccctgatcaagaagtaccctaaacttgaatcggagtttgtgtacggagactacaaggtctacgacgtgaggaagatgatagccaagtccgaacaggaaatcgggaaagcaactgcgaaatacttcttttactcaaacatcatgaacttcttcaagactgaaattacgctggccaatggagaaatcaggaagaggccactgatcgaaactaacggagaaacgggcgaaatcgtgtgggacaagggcagggacttcgcaactgttcgcaaagtgctctctatgccgcaagtcaatattgtgaagaaaaccgaagtgcaaaccggcggattttcaaaggaatcgatcctcccaaagagaaatagcgacaagctcattgcacgcaagaaagactgggacccgaagaagtacggaggattcgattcgccgactgtcgcatactccgtcctcgtggtggccaaggtggagaagggaaagagcaagaagctcaaatccgtcaaagagctgctggggattaccatcatggaacgatcctcgttcgagaagaacccgattgatttcctggaggcgaagggttacaaggaggtgaagaaggatctgatcatcaaactgcccaagtactcactgttcgaactggaaaatggtcggaagcgcatgctggcttcggccggagaactccagaaaggaaatgagctggccttgcctagcaagtacgtcaacttcctctatcttgcttcgcactacgagaaactcaaagggtcaccggaagataacgaacagaagcagcttttcgtggagcagcacaagcattatctggatgaaatcatcgaacaaatctccgagttttcaaagcgcgtgatcctcgccgacgccaacctcgacaaagtcctgtcggcctacaataagcatagagataagccgatcagagaacaggccgagaacattatccacttgttcaccctgactaacctgggagctccagccgccttcaagtacttcgatactactatcgaccgcaaaagatacacgtccaccaaggaagttctggacgcgaccctgatccaccaaagcatcactggactctacgaaactaggatcgatctgtcgcagctgggtggcgatggtggcggtggatcctacccatacgacgtgcctgactacgcctccggaggtggtggccccaagaagaaacggaaggtgtgatagctagccatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctcgag

SEQ ID NO: 48 - DNA, 4403 bp, Artificial Sequence
  Synthetic: Cas9 transcript comprising Cas9 ORF using codons with generally high expression in humans
gggtcccgcagtcggcgtccagcggctctgcttgttcgtgtgtgtgtcgttgcaggccttattcggatccatgcctaagaaaaagcggaaggtcgacggggataagaagtactcaatcgggctggatatcggaactaattccgtgggttgggcagtgatcacggatgaatacaaagtgccgtccaagaagttcaaggtcctggggaacaccgatagacacagcatcaagaaaaatctcatcggagccctgctgtttgactccggcgaaaccgcagaagcgacccggctcaaacgtaccgcgaggcgacgctacacccggcggaagaatcgcatctgctatctgcaagagatcttttcgaacgaaatggcaaaggtcgacgacagcttcttccaccgcctggaagaatctttcctggtggaggaggacaagaagcatgaacggcatcctatctttggaaacatcgtcgacgaagtggcgtaccacgaaaagtacccgaccatctaccatctgcggaagaagttggttgactcaactgacaaggccgacctcagattgatctacttggccctcgcccatatgatcaaattccgcggacacttcctgatcgaaggcgatctgaaccctgataactccgacgtggataagcttttcattcaactggtgcagacctacaaccaactgttcgaagaaaacccaatcaatgctagcggcgtcgatgccaaggccatcctgtccgcccggctgtcgaagtcgcggcgcctcgaaaacctgatcgcacagctgccgggagagaaaaagaacggacttttcggcaacttgatcgctctctcactgggactcactcccaatttcaagtccaattttgacctggccgaggacgcgaagctgcaactctcaaaggacacctacgacgacgacttggacaatttgctggcacaaattggcgatcagtacgcggatctgttccttgccgctaagaacctttcggacgcaatcttgctgtccgatatcctgcgcgtgaacaccgaaataaccaaagcgccgcttagcgcctcgatgattaagcggtacgacgagcatcaccaggatctcacgctgctcaaagcgctcgtgagacagcaactgcctgaaaagtacaaggagatcttcttcgaccagtccaagaatgggtacgcagggtacatcgatggaggcgctagccaggaagagttctataagttcatcaagccaatcctggaaaagatggacggaaccgaagaactgctggtcaagctgaacagggaggatctgctccggaaacagagaacctttgacaacggatccattccccaccagatccatctgggtgagctgcacgccatcttgcggcgccaggaggacttttacccattcctcaaggacaaccgggaaaagatcgagaaaattctgacgttccgcatcccgtattacgtgggcccactggcgcgcggcaattcgcgcttcgcgtggatgactagaaaatcagaggaaaccatcactccttggaatttcgaggaagttgtggataagggagcttcggcacaaagcttcatcgaacgaatgaccaacttcgacaagaatctcccaaacgagaaggtgcttcctaagcacagcctcctttacgaatacttcactgtctacaacgaactgactaaagtgaaatacgttactgaaggaatgaggaagccggcctttctgtccggagaacagaagaaagcaattgtcgatctgctgttcaagaccaaccgcaaggtgaccgtcaagcagcttaaagaggactacttcaagaagatcgagtgtttcgactcagtggaaatcagcggggtggaggacagattcaacgcttcgctgggaacctatcatgatctcctgaagatcatcaaggacaaggacttccttgacaacgaggagaacgaggacatcctggaagatatcgtcctgaccttgacccttttcgaggatcgcgagatgatcgaggagaggcttaagacctacgctcatctcttcgacgataaggtcatgaaacaactcaagcgccgccggtacactggttggggccgcctctcccgcaagctgatcaacggtattcgcgataaacagagcggtaaaactatcctggatttcctcaaatcggatggcttcgctaatcgtaacttcatgcaattgatccacgacgacagcctgacctttaaggaggacatccaaaaagcacaagtgtccggacagggagactcactccatgaacacatcgcgaatctggccggttcgccggcgattaagaagggaattctgcaaactgtgaaggtggtcgacgagctggtgaaggtcatgggacggcacaaaccggagaatatcgtgattgaaatggcccgagaaaaccagactacccagaagggccagaaaaactcccgcgaaaggatgaagcggatcgaagaaggaatcaaggagctgggcagccagatcctgaaagagcacccggtggaaaacacgcagctgcagaacgagaagctctacctgtactatttgcaaaatggacgggacatgtacgtggaccaagagctggacatcaatcggttgtctgattacgacgtggaccacatcgttccacagtcctttctgaaggatgactcgatcgataacaaggtgttgactcgcagcgacaagaacagagggaagtcagataatgtgccatcggaggaggtcgtgaagaagatgaagaattactggcggcagctcctgaatgcgaagctgattacccagagaaagtttgacaatctcactaaagccgagcgcggcggactctcagagctggataaggctggattcatcaaacggcagctggtcgagactcggcagattaccaagcacgtggcgcagatcttggactcccgcatgaacactaaatacgacgagaacgataagctcatccgggaagtgaaggtgattaccctgaaaagcaaacttgtgtcggactttcggaaggactttcagttttacaaagtgagagaaatcaacaactaccatcacgcgcatgacgcatacctcaacgctgtggtcggtaccgccctgatcaaaaagtaccctaaacttgaatcggagtttgtgtacggagactacaaggtctacgacgtgaggaagatgatagccaagtccgaacaggaaatcgggaaagcaactgcgaaatacttcttttactcaaacatcatgaactttttcaagactgaaattacgctggccaatggagaaatcaggaagaggccactgatcgaaactaacggagaaacgggcgaaatcgtgtgggacaagggcagggacttcgcaactgttcgcaaagtgctctctatgccgcaagtcaatattgtgaagaaaaccgaagtgcaaaccggcggattttcaaaggaatcgatcctcccaaagagaaatagcgacaagctcattgcacgcaagaaagactgggacccgaagaagtacggaggattcgattcgccgactgtcgcatactccgtcctcgtggtggccaaggtggagaagggaaagagcaaaaagctcaaatccgtcaaagagctgctggggattaccatcatggaacgatcctcgttcgagaagaacccgattgatttcctcgaggcgaagggttacaaggaggtgaagaaggatctgatcatcaaactccccaagtactcactgttcgaactggaaaatggtcggaagcgcatgctggcttcggccggagaactccaaaaaggaaatgagctggccttgcctagcaagtacgtcaacttcctctatcttgcttcgcactacgaaaaactcaaagggtcaccggaagataacgaacagaagcagcttttcgtggagcagcacaagcattatctggatgaaatcatcgaacaaatctccgagttttcaaagcgcgtgatcctcgccgacgccaacctcgacaaagtcctgtcggcctacaataagcatagagataagccgatcagagaacaggccgagaacattatccacttgttcaccctgactaacctgggagccccagccgccttcaagtacttcgatactactatcgatcgcaaaagatacacgtccaccaaggaagttctggacgcgaccctgatccaccaaagcatcactggactctacgaaactaggatcgatctgtcgcagctgggtggcgattgatagtctagccatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctcgag

SEQ ID NO: 49 - DNA, 4409 bp, Artificial Sequence
  Synthetic: Cas9 transcript comprising Kozak sequence with Cas9 ORF using codons with generally high expression in humans
gggtcccgcagtcggcgtccagcggctctgcttgttcgtgtgtgtgtcgttgcaggccttattcggatccgccaccatgcctaagaaaaagcggaaggtcgacggggataagaagtactcaatcgggctggatatcggaactaattccgtgggttgggcagtgatcacggatgaatacaaagtgccgtccaagaagttcaaggtcctggggaacaccgatagacacagcatcaagaaaaatctcatcggagccctgctgtttgactccggcgaaaccgcagaagcgacccggctcaaacgtaccgcgaggcgacgctacacccggcggaagaatcgcatctgctatctgcaagagatcttttcgaacgaaatggcaaaggtcgacgacagcttcttccaccgcctggaagaatctttcctggtggaggaggacaagaagcatgaacggcatcctatctttggaaacatcgtcgacgaagtggcgtaccacgaaaagtacccgaccatctaccatctgcggaagaagttggttgactcaactgacaaggccgacctcagattgatctacttggccctcgcccatatgatcaaattccgcggacacttcctgatcgaaggcgatctgaaccctgataactccgacgtggataagcttttcattcaactggtgcagacctacaaccaactgttcgaagaaaacccaatcaatgctagcggcgtcgatgccaaggccatcctgtccgcccggctgtcgaagtcgcggcgcctcgaaaacctgatcgcacagctgccgggagagaaaaagaacggacttttcggcaacttgatcgctctctcactgggactcactcccaatttcaagtccaattttgacctggccgaggacgcgaagctgcaactctcaaaggacacctacgacgacgacttggacaatttgctggcacaaattggcgatcagtacgcggatctgttccttgccgctaagaacctttcggacgcaatcttgctgtccgatatcctgcgcgtgaacaccgaaataaccaaagcgccgcttagcgcctcgatgattaagcggtacgacgagcatcaccaggatctcacgctgctcaaagcgctcgtgagacagcaactgcctgaaaagtacaaggagatcttcttcgaccagtccaagaatgggtacgcagggtacatcgatggaggcgctagccaggaagagttctataagttcatcaagccaatcctggaaaagatggacggaaccgaagaactgctggtcaagctgaacagggaggatctgctccggaaacagagaacctttgacaacggatccattccccaccagatccatctgggtgagctgcacgccatcttgcggcgccaggaggacttttacccattcctcaaggacaaccgggaaaagatcgagaaaattctgacgttccgcatcccgtattacgtgggcccactggcgcgcggcaattcgcgcttcgcgtggatgactagaaaatcagaggaaaccatcactccttggaatttcgaggaagttgtggataagggagcttcggcacaaagcttcatcgaacgaatgaccaacttcgacaagaatctcccaaacgagaaggtgcttcctaagcacagcctcctttacgaatacttcactgtctacaacgaactgactaaagtgaaatacgttactgaaggaatgaggaagccggcctttctgtccggagaacagaagaaagcaattgtcgatctgctgttcaagaccaaccgcaaggtgaccgtcaagcagcttaaagaggactacttcaagaagatcgagtgtttcgactcagtggaaatcagcggggtggaggacagattcaacgcttcgctgggaacctatcatgatctcctgaagatcatcaaggacaaggacttccttgacaacgaggagaacgaggacatcctggaagatatcgtcctgaccttgacccttttcgaggatcgcgagatgatcgaggagaggcttaagacctacgctcatctcttcgacgataaggtcatgaaacaactcaagcgccgccggtacactggttggggccgcctctcccgcaagctgatcaacggtattcgcgataaacagagcggtaaaactatcctggatttcctcaaatcggatggcttcgctaatcgtaacttcatgcaattgatccacgacgacagcctgacctttaaggaggacatccaaaaagcacaagtgtccggacagggagactcactccatgaacacatcgcgaatctggccggttcgccggcgattaagaagggaattctgcaaactgtgaaggtggtcgacgagctggtgaaggtcatgggacggcacaaaccggagaatatcgtgattgaaatggcccgagaaaaccagactacccagaagggccagaaaaactcccgcgaaaggatgaagcggatcgaagaaggaatcaaggagctgggcagccagatcctgaaagagcacccggtggaaaacacgcagctgcagaacgagaagctctacctgtactatttgcaaaatggacgggacatgtacgtggaccaagagctggacatcaatcggttgtctgattacgacgtggaccacatcgttccacagtcctttctgaaggatgactcgatcgataacaaggtgttgactcgcagcgacaagaacagagggaagtcagataatgtgccatcggaggaggtcgtgaagaagatgaagaattactggcggcagctcctgaatgcgaagctgattacccagagaaagtttgacaatctcactaaagccgagcgcggcggactctcagagctggataaggctggattcatcaaacggcagctggtcgagactcggcagattaccaagcacgtggcgcagatcttggactcccgcatgaacactaaatacgacgagaacgataagctcatccgggaagtgaaggtgattaccctgaaaagcaaacttgtgtcggactttcggaaggactttcagttttacaaagtgagagaaatcaacaactaccatcacgcgcatgacgcatacctcaacgctgtggtcggtaccgccctgatcaaaaagtaccctaaacttgaatcggagtttgtgtacggagactacaaggtctacgacgtgaggaagatgatagccaagtccgaacaggaaatcgggaaagcaactgcgaaatacttcttttactcaaacatcatgaactttttcaagactgaaattacgctggccaatggagaaatcaggaagaggccactgatcgaaactaacggagaaacgggcgaaatcgtgtgggacaagggcagggacttcgcaactgttcgcaaagtgctctctatgccgcaagtcaatattgtgaagaaaaccgaagtgcaaaccggcggattttcaaaggaatcgatcctcccaaagagaaatagcgacaagctcattgcacgcaagaaagactgggacccgaagaagtacggaggattcgattcgccgactgtcgcatactccgtcctcgtggtggccaaggtggagaagggaaagagcaaaaagctcaaatccgtcaaagagctgctggggattaccatcatggaacgatcctcgttcgagaagaacccgattgatttcctcgaggcgaagggttacaaggaggtgaagaaggatctgatcatcaaactccccaagtactcactgttcgaactggaaaatggtcggaagcgcatgctggcttcggccggagaactccaaaaaggaaatgagctggccttgcctagcaagtacgtcaacttcctctatcttgcttcgcactacgaaaaactcaaagggtcaccggaagataacgaacagaagcagcttttcgtggagcagcacaagcattatctggatgaaatcatcgaacaaatctccgagttttcaaagcgcgtgatcctcgccgacgccaacctcgacaaagtcctgtcggcctacaataagcatagagataagccgatcagagaacaggccgagaacattatccacttgttcaccctgactaacctgggagccccagccgccttcaagtacttcgatactactatcgatcgcaaaagatacacgtccaccaaggaagttctggacgcgaccctgatccaccaaagcatcactggactctacgaaactaggatcgatctgtcgcagctgggtggcgattgatagtctagccatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctcgag

SEQ ID NO: 50 - DNA, 4140 bp, Artificial Sequence
  Synthetic: Cas9 ORF with splice junctions removed; 12.75% U content
atggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccaccggctggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcaaaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcccgaagaagaagagaaaggtctag

SEQ ID NO: 51 - DNA, 4411 bp, Artificial Sequence
  Synthetic: Cas9 transcript with 5 UTR of HSD, ORF corresponding to SEQ ID NO: 50, Kozak sequence, and 3 UTR of ALB
gggtcccgcagtcggcgtccagcggctctgcttgttcgtgtgtgtgtcgttgcaggccttattcggatccgccaccatggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccaccggctggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcaaaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcccgaagaagaagagaaaggtctagctagccatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctcgag

SEQ ID NO: 52 - DNA, 4140 bp, Artificial Sequence
  Synthetic: Cas9 ORF with minimal uridine codons frequently used in humans in general; 12.75% U content
atggacaagaagtacagcatcggcctggacatcggcaccaacagcgtgggctgggccgtgatcaccgacgagtacaaggtgcccagcaagaagttcaaggtgctgggcaacaccgacagacacagcatcaagaagaacctgatcggcgccctgctgttcgacagcggcgagaccgccgaggccaccagactgaagagaaccgccagaagaagatacaccagaagaaagaacagaatctgctacctgcaggagatcttcagcaacgagatggccaaggtggacgacagcttcttccacagactggaggagagcttcctggtggaggaggacaagaagcacgagagacaccccatcttcggcaacatcgtggacgaggtggcctaccacgagaagtaccccaccatctaccacctgagaaagaagctggtggacagcaccgacaaggccgacctgagactgatctacctggccctggcccacatgatcaagttcagaggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgccagactgagcaagagcagaagactggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagagtgaacaccgagatcaccaaggcccccctgagcgccagcatgatcaagagatacgacgagcaccaccaggacctgaccctgctgaaggccctggtgagacagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaacagagaggacctgctgagaaagcagagaaccttcgacaacggcagcatcccccaccagatccacctgggcgagctgcacgccatcctgagaagacaggaggacttctaccccttcctgaaggacaacagagagaagatcgagaagatcctgaccttcagaatcccctactacgtgggccccctggccagaggcaacagcagattcgcctggatgaccagaaagagcgaggagaccatcaccccctggaacttcgaggaggtggtggacaagggcgccagcgcccagagcttcatcgagagaatgaccaacttcgacaagaacctgcccaacgagaaggtgctgcccaagcacagcctgctgtacgagtacttcaccgtgtacaacgagctgaccaaggtgaagtacgtgaccgagggcatgagaaagcccgccttcctgagcggcgagcagaagaaggccatcgtggacctgctgttcaagaccaacagaaaggtgaccgtgaagcagctgaaggaggactacttcaagaagatcgagtgcttcgacagcgtggagatcagcggcgtggaggacagattcaacgccagcctgggcacctaccacgacctgctgaagatcatcaaggacaaggacttcctggacaacgaggagaacgaggacatcctggaggacatcgtgctgaccctgaccctgttcgaggacagagagatgatcgaggagagactgaagacctacgcccacctgttcgacgacaaggtgatgaagcagctgaagagaagaagatacaccggctggggcagactgagcagaaagctgatcaacggcatcagagacaagcagagcggcaagaccatcctggacttcctgaagagcgacggcttcgccaacagaaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggcagacacaagcccgagaacatcgtgatcgagatggccagagagaaccagaccacccagaagggccagaagaacagcagagagagaatgaagagaatcgaggagggcatcaaggagctgggcagccagatcctgaaggagcaccccgtggagaacacccagctgcagaacgagaagctgtacctgtactacctgcagaacggcagagacatgtacgtggaccaggagctggacatcaacagactgagcgactacgacgtggaccacatcgtgccccagagcttcctgaaggacgacagcatcgacaacaaggtgctgaccagaagcgacaagaacagaggcaagagcgacaacgtgcccagcgaggaggtggtgaagaagatgaagaactactggagacagctgctgaacgccaagctgatcacccagagaaagttcgacaacctgaccaaggccgagagaggcggcctgagcgagctggacaaggccggcttcatcaagagacagctggtggagaccagacagatcaccaagcacgtggcccagatcctggacagcagaatgaacaccaagtacgacgagaacgacaagctgatcagagaggtgaaggtgatcaccctgaagagcaagctggtgagcgacttcagaaaggacttccagttctacaaggtgagagagatcaacaactaccaccacgcccacgacgcctacctgaacgccgtggtgggcaccgccctgatcaagaagtaccccaagctggagagcgagttcgtgtacggcgactacaaggtgtacgacgtgagaaagatgatcgccaagagcgagcaggagatcggcaaggccaccgccaagtacttcttctacagcaacatcatgaacttcttcaagaccgagatcaccctggccaacggcgagatcagaaagagacccctgatcgagaccaacggcgagaccggcgagatcgtgtgggacaagggcagagacttcgccaccgtgagaaaggtgctgagcatgccccaggtgaacatcgtgaagaagaccgaggtgcagaccggcggcttcagcaaggagagcatcctgcccaagagaaacagcgacaagctgatcgccagaaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagagaagcagcttcgagaagaaccccatcgacttcctggaggccaagggctacaaggaggtgaagaaggacctgatcatcaagctgcccaagtacagcctgttcgagctggagaacggcagaaagagaatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagagagtgatcctggccgacgccaacctggacaaggtgctgagcgcctacaacaagcacagagacaagcccatcagagagcaggccgagaacatcatccacctgttcaccctgaccaacctgggcgcccccgccgccttcaagtacttcgacaccaccatcgacagaaagagatacaccagcaccaaggaggtgctggacgccaccctgatccaccagagcatcaccggcctgtacgagaccagaatcgacctgagccagctgggcggcgacggcggcggcagccccaagaagaagagaaaggtgtga

SEQ ID NO: 53 - DNA, 4411 bp, Artificial Sequence
  Synthetic: Cas9 transcript with 5 UTR of HSD, ORF corresponding to SEQ ID NO: 52, Kozak sequence, and 3 UTR of ALB
gggtcccgcagtcggcgtccagcggctctgcttgttcgtgtgtgtgtcgttgcaggccttattcggatccgccaccatggacaagaagtacagcatcggcctggacatcggcaccaacagcgtgggctgggccgtgatcaccgacgagtacaaggtgcccagcaagaagttcaaggtgctgggcaacaccgacagacacagcatcaagaagaacctgatcggcgccctgctgttcgacagcggcgagaccgccgaggccaccagactgaagagaaccgccagaagaagatacaccagaagaaagaacagaatctgctacctgcaggagatcttcagcaacgagatggccaaggtggacgacagcttcttccacagactggaggagagcttcctggtggaggaggacaagaagcacgagagacaccccatcttcggcaacatcgtggacgaggtggcctaccacgagaagtaccccaccatctaccacctgagaaagaagctggtggacagcaccgacaaggccgacctgagactgatctacctggccctggcccacatgatcaagttcagaggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgccagactgagcaagagcagaagactggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgagagtgaacaccgagatcaccaaggcccccctgagcgccagcatgatcaagagatacgacgagcaccaccaggacctgaccctgctgaaggccctggtgagacagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaacagagaggacctgctgagaaagcagagaaccttcgacaacggcagcatcccccaccagatccacctgggcgagctgcacgccatcctgagaagacaggaggacttctaccccttcctgaaggacaacagagagaagatcgagaagatcctgaccttcagaatcccctactacgtgggccccctggccagaggcaacagcagattcgcctggatgaccagaaagagcgaggagaccatcaccccctggaacttcgaggaggtggtggacaagggcgccagcgcccagagcttcatcgagagaatgaccaacttcgacaagaacctgcccaacgagaaggtgctgcccaagcacagcctgctgtacgagtacttcaccgtgtacaacgagctgaccaaggtgaagtacgtgaccgagggcatgagaaagcccgccttcctgagcggcgagcagaagaaggccatcgtggacctgctgttcaagaccaacagaaaggtgaccgtgaagcagctgaaggaggactacttcaagaagatcgagtgcttcgacagcgtggagatcagcggcgtggaggacagattcaacgccagcctgggcacctaccacgacctgctgaagatcatcaaggacaaggacttcctggacaacgaggagaacgaggacatcctggaggacatcgtgctgaccctgaccctgttcgaggacagagagatgatcgaggagagactgaagacctacgcccacctgttcgacgacaaggtgatgaagcagctgaagagaagaagatacaccggctggggcagactgagcagaaagctgatcaacggcatcagagacaagcagagcggcaagaccatcctggacttcctgaagagcgacggcttcgccaacagaaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggcagacacaagcccgagaacatcgtgatcgagatggccagagagaaccagaccacccagaagggccagaagaacagcagagagagaatgaagagaatcgaggagggcatcaaggagctgggcagccagatcctgaaggagcaccccgtggagaacacccagctgcagaacgagaagctgtacctgtactacctgcagaacggcagagacatgtacgtggaccaggagctggacatcaacagactgagcgactacgacgtggaccacatcgtgccccagagcttcctgaaggacgacagcatcgacaacaaggtgctgaccagaagcgacaagaacagaggcaagagcgacaacgtgcccagcgaggaggtggtgaagaagatgaagaactactggagacagctgctgaacgccaagctgatcacccagagaaagttcgacaacctgaccaaggccgagagaggcggcctgagcgagctggacaaggccggcttcatcaagagacagctggtggagaccagacagatcaccaagcacgtggcccagatcctggacagcagaatgaacaccaagtacgacgagaacgacaagctgatcagagaggtgaaggtgatcaccctgaagagcaagctggtgagcgacttcagaaaggacttccagttctacaaggtgagagagatcaacaactaccaccacgcccacgacgcctacctgaacgccgtggtgggcaccgccctgatcaagaagtaccccaagctggagagcgagttcgtgtacggcgactacaaggtgtacgacgtgagaaagatgatcgccaagagcgagcaggagatcggcaaggccaccgccaagtacttcttctacagcaacatcatgaacttcttcaagaccgagatcaccctggccaacggcgagatcagaaagagacccctgatcgagaccaacggcgagaccggcgagatcgtgtgggacaagggcagagacttcgccaccgtgagaaaggtgctgagcatgccccaggtgaacatcgtgaagaagaccgaggtgcagaccggcggcttcagcaaggagagcatcctgcccaagagaaacagcgacaagctgatcgccagaaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagagaagcagcttcgagaagaaccccatcgacttcctggaggccaagggctacaaggaggtgaagaaggacctgatcatcaagctgcccaagtacagcctgttcgagctggagaacggcagaaagagaatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagagagtgatcctggccgacgccaacctggacaaggtgctgagcgcctacaacaagcacagagacaagcccatcagagagcaggccgagaacatcatccacctgttcaccctgaccaacctgggcgcccccgccgccttcaagtacttcgacaccaccatcgacagaaagagatacaccagcaccaaggaggtgctggacgccaccctgatccaccagagcatcaccggcctgtacgagaccagaatcgacctgagccagctgggcggcgacggcggcggcagccccaagaagaagagaaaggtgtgactagccatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctcgag

SEQ ID NO: 54 - DNA, 4140 bp, Artificial Sequence
  Synthetic: Cas9 ORF with minimal uridine codons infrequently used in humans in general; 12.75% U content
atggacaaaaaatacagcatagggctagacatagggacgaacagcgtagggtgggcggtaataacggacgaatacaaagtaccgagcaaaaaattcaaagtactagggaacacggaccgacacagcataaaaaaaaacctaataggggcgctactattcgacagcggggaaacggcggaagcgacgcgactaaaacgaacggcgcgacgacgatacacgcgacgaaaaaaccgaatatgctacctacaagaaatattcagcaacgaaatggcgaaagtagacgacagcttcttccaccgactagaagaaagcttcctagtagaagaagacaaaaaacacgaacgacacccgatattcgggaacatagtagacgaagtagcgtaccacgaaaaatacccgacgatataccacctacgaaaaaaactagtagacagcacggacaaagcggacctacgactaatatacctagcgctagcgcacatgataaaattccgagggcacttcctaatagaaggggacctaaacccggacaacagcgacgtagacaaactattcatacaactagtacaaacgtacaaccaactattcgaagaaaacccgataaacgcgagcggggtagacgcgaaagcgatactaagcgcgcgactaagcaaaagccgacgactagaaaacctaatagcgcaactaccgggggaaaaaaaaaacgggctattcgggaacctaatagcgctaagcctagggctaacgccgaacttcaaaagcaacttcgacctagcggaagacgcgaaactacaactaagcaaagacacgtacgacgacgacctagacaacctactagcgcaaataggggaccaatacgcggacctattcctagcggcgaaaaacctaagcgacgcgatactactaagcgacatactacgagtaaacacggaaataacgaaagcgccgctaagcgcgagcatgataaaacgatacgacgaacaccaccaagacctaacgctactaaaagcgctagtacgacaacaactaccggaaaaatacaaagaaatattcttcgaccaaagcaaaaacgggtacgcggggtacatagacgggggggcgagccaagaagaattctacaaattcataaaaccgatactagaaaaaatggacgggacggaagaactactagtaaaactaaaccgagaagacctactacgaaaacaacgaacgttcgacaacgggagcataccgcaccaaatacacctaggggaactacacgcgatactacgacgacaagaagacttctacccgttcctaaaagacaaccgagaaaaaatagaaaaaatactaacgttccgaataccgtactacgtagggccgctagcgcgagggaacagccgattcgcgtggatgacgcgaaaaagcgaagaaacgataacgccgtggaacttcgaagaagtagtagacaaaggggcgagcgcgcaaagcttcatagaacgaatgacgaacttcgacaaaaacctaccgaacgaaaaagtactaccgaaacacagcctactatacgaatacttcacggtatacaacgaactaacgaaagtaaaatacgtaacggaagggatgcgaaaaccggcgttcctaagcggggaacaaaaaaaagcgatagtagacctactattcaaaacgaaccgaaaagtaacggtaaaacaactaaaagaagactacttcaaaaaaatagaatgcttcgacagcgtagaaataagcggggtagaagaccgattcaacgcgagcctagggacgtaccacgacctactaaaaataataaaagacaaagacttcctagacaacgaagaaaacgaagacatactagaagacatagtactaacgctaacgctattcgaagaccgagaaatgatagaagaacgactaaaaacgtacgcgcacctattcgacgacaaagtaatgaaacaactaaaacgacgacgatacacggggtgggggcgactaagccgaaaactaataaacgggatacgagacaaacaaagcgggaaaacgatactagacttcctaaaaagcgacgggttcgcgaaccgaaacttcatgcaactaatacacgacgacagcctaacgttcaaagaagacatacaaaaagcgcaagtaagcgggcaaggggacagcctacacgaacacatagcgaacctagcggggagcccggcgataaaaaaagggatactacaaacggtaaaagtagtagacgaactagtaaaagtaatggggcgacacaaaccggaaaacatagtaatagaaatggcgcgagaaaaccaaacgacgcaaaaagggcaaaaaaacagccgagaacgaatgaaacgaatagaagaagggataaaagaactagggagccaaatactaaaagaacacccggtagaaaacacgcaactacaaaacgaaaaactatacctatactacctacaaaacgggcgagacatgtacgtagaccaagaactagacataaaccgactaagcgactacgacgtagaccacatagtaccgcaaagcttcctaaaagacgacagcatagacaacaaagtactaacgcgaagcgacaaaaaccgagggaaaagcgacaacgtaccgagcgaagaagtagtaaaaaaaatgaaaaactactggcgacaactactaaacgcgaaactaataacgcaacgaaaattcgacaacctaacgaaagcggaacgaggggggctaagcgaactagacaaagcggggttcataaaacgacaactagtagaaacgcgacaaataacgaaacacgtagcgcaaatactagacagccgaatgaacacgaaatacgacgaaaacgacaaactaatacgagaagtaaaagtaataacgctaaaaagcaaactagtaagcgacttccgaaaagacttccaattctacaaagtacgagaaataaacaactaccaccacgcgcacgacgcgtacctaaacgcggtagtagggacggcgctaataaaaaaatacccgaaactagaaagcgaattcgtatacggggactacaaagtatacgacgtacgaaaaatgatagcgaaaagcgaacaagaaatagggaaagcgacggcgaaatacttcttctacagcaacataatgaacttcttcaaaacggaaataacgctagcgaacggggaaatacgaaaacgaccgctaatagaaacgaacggggaaacgggggaaatagtatgggacaaagggcgagacttcgcgacggtacgaaaagtactaagcatgccgcaagtaaacatagtaaaaaaaacggaagtacaaacgggggggttcagcaaagaaagcatactaccgaaacgaaacagcgacaaactaatagcgcgaaaaaaagactgggacccgaaaaaatacggggggttcgacagcccgacggtagcgtacagcgtactagtagtagcgaaagtagaaaaagggaaaagcaaaaaactaaaaagcgtaaaagaactactagggataacgataatggaacgaagcagcttcgaaaaaaacccgatagacttcctagaagcgaaagggtacaaagaagtaaaaaaagacctaataataaaactaccgaaatacagcctattcgaactagaaaacgggcgaaaacgaatgctagcgagcgcgggggaactacaaaaagggaacgaactagcgctaccgagcaaatacgtaaacttcctatacctagcgagccactacgaaaaactaaaagggagcccggaagacaacgaacaaaaacaactattcgtagaacaacacaaacactacctagacgaaataatagaacaaataagcgaattcagcaaacgagtaatactagcggacgcgaacctagacaaagtactaagcgcgtacaacaaacaccgagacaaaccgatacgagaacaagcggaaaacataatacacctattcacgctaacgaacctaggggcgccggcggcgttcaaatacttcgacacgacgatagaccgaaaacgatacacgagcacgaaagaagtactagacgcgacgctaatacaccaaagcataacggggctatacgaaacgcgaatagacctaagccaactagggggggacgggggggggagcccgaaaaaaaaacgaaaagtatga

SEQ ID NO: 55 - DNA, 4411 bp, Artificial Sequence
  Synthetic: Cas9 transcript with 5 UTR of HSD, ORF corresponding to SEQ ID NO: 54, Kozak sequence, and 3 UTR of ALB
gggtcccgcagtcggcgtccagcggctctgcttgttcgtgtgtgtgtcgttgcaggccttattcggatccgccaccatggacaaaaaatacagcatagggctagacatagggacgaacagcgtagggtgggcggtaataacggacgaatacaaagtaccgagcaaaaaattcaaagtactagggaacacggaccgacacagcataaaaaaaaacctaataggggcgctactattcgacagcggggaaacggcggaagcgacgcgactaaaacgaacggcgcgacgacgatacacgcgacgaaaaaaccgaatatgctacctacaagaaatattcagcaacgaaatggcgaaagtagacgacagcttcttccaccgactagaagaaagcttcctagtagaagaagacaaaaaacacgaacgacacccgatattcgggaacatagtagacgaagtagcgtaccacgaaaaatacccgacgatataccacctacgaaaaaaactagtagacagcacggacaaagcggacctacgactaatatacctagcgctagcgcacatgataaaattccgagggcacttcctaatagaaggggacctaaacccggacaacagcgacgtagacaaactattcatacaactagtacaaacgtacaaccaactattcgaagaaaacccgataaacgcgagcggggtagacgcgaaagcgatactaagcgcgcgactaagcaaaagccgacgactagaaaacctaatagcgcaactaccgggggaaaaaaaaaacgggctattcgggaacctaatagcgctaagcctagggctaacgccgaacttcaaaagcaacttcgacctagcggaagacgcgaaactacaactaagcaaagacacgtacgacgacgacctagacaacctactagcgcaaataggggaccaatacgcggacctattcctagcggcgaaaaacctaagcgacgcgatactactaagcgacatactacgagtaaacacggaaataacgaaagcgccgctaagcgcgagcatgataaaacgatacgacgaacaccaccaagacctaacgctactaaaagcgctagtacgacaacaactaccggaaaaatacaaagaaatattcttcgaccaaagcaaaaacgggtacgcggggtacatagacgggggggcgagccaagaagaattctacaaattcataaaaccgatactagaaaaaatggacgggacggaagaactactagtaaaactaaaccgagaagacctactacgaaaacaacgaacgttcgacaacgggagcataccgcaccaaatacacctaggggaactacacgcgatactacgacgacaagaagacttctacccgttcctaaaagacaaccgagaaaaaatagaaaaaatactaacgttccgaataccgtactacgtagggccgctagcgcgagggaacagccgattcgcgtggatgacgcgaaaaagcgaagaaacgataacgccgtggaacttcgaagaagtagtagacaaaggggcgagcgcgcaaagcttcatagaacgaatgacgaacttcgacaaaaacctaccgaacgaaaaagtactaccgaaacacagcctactatacgaatacttcacggtatacaacgaactaacgaaagtaaaatacgtaacggaagggatgcgaaaaccggcgttcctaagcggggaacaaaaaaaagcgatagtagacctactattcaaaacgaaccgaaaagtaacggtaaaacaactaaaagaagactacttcaaaaaaatagaatgcttcgacagcgtagaaataagcggggtagaagaccgattcaacgcgagcctagggacgtaccacgacctactaaaaataataaaagacaaagacttcctagacaacgaagaaaacgaagacatactagaagacatagtactaacgctaacgctattcgaagaccgagaaatgatagaagaacgactaaaaacgtacgcgcacctattcgacgacaaagtaatgaaacaactaaaacgacgacgatacacggggtgggggcgactaagccgaaaactaataaacgggatacgagacaaacaaagcgggaaaacgatactagacttcctaaaaagcgacgggttcgcgaaccgaaacttcatgcaactaatacacgacgacagcctaacgttcaaagaagacatacaaaaagcgcaagtaagcgggcaaggggacagcctacacgaacacatagcgaacctagcggggagcccggcgataaaaaaagggatactacaaacggtaaaagtagtagacgaactagtaaaagtaatggggcgacacaaaccggaaaacatagtaatagaaatggcgcgagaaaaccaaacgacgcaaaaagggcaaaaaaacagccgagaacgaatgaaacgaatagaagaagggataaaagaactagggagccaaatactaaaagaacacccggtagaaaacacgcaactacaaaacgaaaaactatacctatactacctacaaaacgggcgagacatgtacgtagaccaagaactagacataaaccgactaagcgactacgacgtagaccacatagtaccgcaaagcttcctaaaagacgacagcatagacaacaaagtactaacgcgaagcgacaaaaaccgagggaaaagcgacaacgtaccgagcgaagaagtagtaaaaaaaatgaaaaactactggcgacaactactaaacgcgaaactaataacgcaacgaaaattcgacaacctaacgaaagcggaacgaggggggctaagcgaactagacaaagcggggttcataaaacgacaactagtagaaacgcgacaaataacgaaacacgtagcgcaaatactagacagccgaatgaacacgaaatacgacgaaaacgacaaactaatacgagaagtaaaagtaataacgctaaaaagcaaactagtaagcgacttccgaaaagacttccaattctacaaagtacgagaaataaacaactaccaccacgcgcacgacgcgtacctaaacgcggtagtagggacggcgctaataaaaaaatacccgaaactagaaagcgaattcgtatacggggactacaaagtatacgacgtacgaaaaatgatagcgaaaagcgaacaagaaatagggaaagcgacggcgaaatacttcttctacagcaacataatgaacttcttcaaaacggaaataacgctagcgaacggggaaatacgaaaacgaccgctaatagaaacgaacggggaaacgggggaaatagtatgggacaaagggcgagacttcgcgacggtacgaaaagtactaagcatgccgcaagtaaacatagtaaaaaaaacggaagtacaaacgggggggttcagcaaagaaagcatactaccgaaacgaaacagcgacaaactaatagcgcgaaaaaaagactgggacccgaaaaaatacggggggttcgacagcccgacggtagcgtacagcgtactagtagtagcgaaagtagaaaaagggaaaagcaaaaaactaaaaagcgtaaaagaactactagggataacgataatggaacgaagcagcttcgaaaaaaacccgatagacttcctagaagcgaaagggtacaaagaagtaaaaaaagacctaataataaaactaccgaaatacagcctattcgaactagaaaacgggcgaaaacgaatgctagcgagcgcgggggaactacaaaaagggaacgaactagcgctaccgagcaaatacgtaaacttcctatacctagcgagccactacgaaaaactaaaagggagcccggaagacaacgaacaaaaacaactattcgtagaacaacacaaacactacctagacgaaataatagaacaaataagcgaattcagcaaacgagtaatactagcggacgcgaacctagacaaagtactaagcgcgtacaacaaacaccgagacaaaccgatacgagaacaagcggaaaacataatacacctattcacgctaacgaacctaggggcgccggcggcgttcaaatacttcgacacgacgatagaccgaaaacgatacacgagcacgaaagaagtactagacgcgacgctaatacaccaaagcataacggggctatacgaaacgcgaatagacctaagccaactagggggggacgggggggggagcccgaaaaaaaaacgaaaagtatgactagccatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctcgag

SEQ ID NO: 56 - DNA, 4411 bp, Artificial Sequence
  Synthetic: Cas9 transcript with AGG as first three nucleotides for use with CleanCapTM, 5 UTR of HSD, ORF corresponding to SEQ ID NO: 4, Kozak sequence, and 3 UTR of ALB
aggtcccgcagtcggcgtccagcggctctgcttgttcgtgtgtgtgtcgttgcaggccttattcggatccgccaccatggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcccgaagaagaagagaaaggtctagctagccatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctcgag

SEQ ID NO: 57 - DNA, 4481 bp, Artificial Sequence
  Synthetic: Cas9 transcript with 5 UTR from CMV, ORF corresponding to SEQ ID NO: 4, Kozak sequence, and 3 UTR of ALB
gggcagatcgcctggagacgccatccacgctgttttgacctccatagaagacaccgggaccgatccagcctccgcggccgggaacggtgcattggaacgcggattccccgtgccaagagtgactcaccgtccttgacacggccaccatggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcccgaagaagaagagaaaggtctagctagccatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctcgag

SEQ ID NO: 58 - DNA, 4348 bp, Artificial Sequence
  Synthetic: Cas9 transcript with 5 UTR from HBB, ORF corresponding to SEQ ID NO: 4, Kozak sequence, and 3 UTR of HBB
gggacatttgcttctgacacaactgtgttcactagcaacctcaaacagacaccggatctgccaccatggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcccgaagaagaagagaaaggtctagctagcgctcgctttcttgctgtccaatttctattaaaggttcctttgttccctaagtccaactactaaactgggggatattatgaagggccttgagcatctggattctgcctaataaaaaacatttattttcattgcctcgag

SEQ ID NO: 59 - DNA, 4325 bp, Artificial Sequence
  Synthetic: Cas9 transcript with 5 UTR from XBG, ORF corresponding to SEQ ID NO: 4, Kozak sequence, and 3 UTR of XBG
gggaagctcagaataaacgctcaactttggccggatctgccaccatggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcccgaagaagaagagaaaggtctagctagcaccagcctcaagaacacccgaatggagtctctaagctacataataccaacttacactttacaaaatgttgtcccccaaaatgtagccattcgtatctgctcctaataaaaagaaagtttcttcacattctctcgag

SEQ ID NO: 60 - DNA, 4325 bp, Artificial Sequence
  Synthetic: Cas9 transcript with AGG as first three nucleotides for use with CleanCapTM, 5 UTR from XBG, ORF corresponding to SEQ ID NO: 4, Kozak sequence, and 3 UTR of XBG
aggaagctcagaataaacgctcaactttggccggatctgccaccatggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcccgaagaagaagagaaaggtctagctagcaccagcctcaagaacacccgaatggagtctctaagctacataataccaacttacactttacaaaatgttgtcccccaaaatgtagccattcgtatctgctcctaataaaaagaaagtttcttcacattctctcgag

SEQ ID NO: 61 - DNA, 4411 bp, Artificial Sequence; identical to SEQ ID NO: 56
  Synthetic: Cas9 transcript with AGG as first three nucleotides for use with CleanCapTM,  5 UTR from HSD, ORF corresponding to SEQ ID NO: 4, Kozak sequence, and 3 UTR of ALB

SEQ ID NO: 62 - DNA, 105 bp, Artificial Sequence
  Synthetic: 30/30/39 poly-A sequence
aaaaaaaaaaaaaaaaaaaaaaaaaaaaaagcgaaaaaaaaaaaaaaaaaaaaaaaaaaaaaaccgaaaaaaaaaaaaaaaaaaaaaaaaaaaaaaaaaaaaaaa

SEQ ID NO: 63 - DNA, 93 bp, Artificial Sequence
  Synthetic: poly-A 100 sequence
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 64 - RNA, 100 nt, Artificial Sequence
  Synthetic: G209 guide RNA
  modified_base (1)..(4): PS linkage
  modified_base (1)..(3): 2'-O-Me nucleotide
  modified_base (96)..(99): 2'-O-Me nucleotide
  modified_base (96)..(100): PS linkage
ccaguccagcgaggcaaaggguuuuagagcuagaaauagcaaguuaaaauaaggcuaguccguuaucaacuugaaaaaguggcaccgagucggugcuuuu

SEQ ID NO: 65 - DNA, 3312 bp, Artificial Sequence
  Synthetic: ORF encoding Neisseria meningitidis Cas9
atggcagcattcaagccgaactcgatcaactacatcctgggactggacatcggaatcgcatcggtcggatgggcaatggtcgaaatcgacgaagaagaaaacccgatcagactgatcgacctgggagtcagagtcttcgaaagagcagaagtcccgaagacaggagactcgctggcaatggcaagaagactggcaagatcggtcagaagactgacaagaagaagagcacacagactgctgagaacaagaagactgctgaagagagaaggagtcctgcaggcagcaaacttcgacgaaaacggactgatcaagtcgctgccgaacacaccgtggcagctgagagcagcagcactggacagaaagctgacaccgctggaatggtcggcagtcctgctgcacctgatcaagcacagaggatacctgtcgcagagaaagaacgaaggagaaacagcagacaaggaactgggagcactgctgaagggagtcgcaggaaacgcacacgcactgcagacaggagacttcagaacaccggcagaactggcactgaacaagttcgaaaaggaatcgggacacatcagaaaccagagatcggactactcgcacacattctcgagaaaggacctgcaggcagaactgatcctgctgttcgaaaagcagaaggaattcggaaacccgcacgtctcgggaggactgaaggaaggaatcgaaacactgctgatgacacagagaccggcactgtcgggagacgcagtccagaagatgctgggacactgcacattcgaaccggcagaaccgaaggcagcaaagaacacatacacagcagaaagattcatctggctgacaaagctgaacaacctgagaatcctggaacagggatcggaaagaccgctgacagacacagaaagagcaacactgatggacgaaccgtacagaaagtcgaagctgacatacgcacaggcaagaaagctgctgggactggaagacacagcattcttcaagggactgagatacggaaaggacaacgcagaagcatcgacactgatggaaatgaaggcataccacgcaatctcgagagcactggaaaaggaaggactgaaggacaagaagtcgccgctgaacctgtcgccggaactgcaggacgaaatcggaacagcattctcgctgttcaagacagacgaagacatcacaggaagactgaaggacagaatccagccggaaatcctggaagcactgctgaagcacatctcgttcgacaagttcgtccagatctcgctgaaggcactgagaagaatcgtcccgctgatggaacagggaaagagatacgacgaagcatgcgcagaaatctacggagaccactacggaaagaagaacacagaagaaaagatctacctgccgccgatcccggcagacgaaatcagaaacccggtcgtcctgagagcactgtcgcaggcaagaaaggtcatcaacggagtcgtcagaagatacggatcgccggcaagaatccacatcgaaacagcaagagaagtcggaaagtcgttcaaggacagaaaggaaatcgaaaagagacaggaagaaaacagaaaggacagagaaaaggcagcagcaaagttcagagaatacttcccgaacttcgtcggagaaccgaagtcgaaggacatcctgaagctgagactgtacgaacagcagcacggaaagtgcctgtactcgggaaaggaaatcaacctgggaagactgaacgaaaagggatacgtcgaaatcgaccacgcactgccgttctcgagaacatgggacgactcgttcaacaacaaggtcctggtcctgggatcggaaaaccagaacaagggaaaccagacaccgtacgaatacttcaacggaaaggacaactcgagagaatggcaggaattcaaggcaagagtcgaaacatcgagattcccgagatcgaagaagcagagaatcctgctgcagaagttcgacgaagacggattcaaggaaagaaacctgaacgacacaagatacgtcaacagattcctgtgccagttcgtcgcagacagaatgagactgacaggaaagggaaagaagagagtcttcgcatcgaacggacagatcacaaacctgctgagaggattctggggactgagaaaggtcagagcagaaaacgacagacaccacgcactggacgcagtcgtcgtcgcatgctcgacagtcgcaatgcagcagaagatcacaagattcgtcagatacaaggaaatgaacgcattcgacggaaagacaatcgacaaggaaacaggagaagtcctgcaccagaagacacacttcccgcagccgtgggaattcttcgcacaggaagtcatgatcagagtcttcggaaagccggacggaaagccggaattcgaagaagcagacacactggaaaagctgagaacactgctggcagaaaagctgtcgtcgagaccggaagcagtccacgaatacgtcacaccgctgttcgtctcgagagcaccgaacagaaagatgtcgggacagggacacatggaaacagtcaagtcggcaaagagactggacgaaggagtctcggtcctgagagtcccgctgacacagctgaagctgaaggacctggaaaagatggtcaacagagaaagagaaccgaagctgtacgaagcactgaaggcaagactggaagcacacaaggacgacccggcaaaggcattcgcagaaccgttctacaagtacgacaaggcaggaaacagaacacagcaggtcaaggcagtcagagtcgaacaggtccagaagacaggagtctgggtcagaaaccacaacggaatcgcagacaacgcaacaatggtcagagtagacgtcttcgaaaagggagacaagtactacctggtcccgatctactcgtggcaggtcgcaaagggaatcctgccggacagagcagtcgtccagggaaaggacgaagaagactggcagctgatcgacgactcgttcaacttcaagttctcgctgcacccgaacgacctggtcgaagtcatcacaaagaaggcaagaatgttcggatacttcgcatcgtgccacagaggaacaggaaacatcaacatcagaatccacgacctggaccacaagatcggaaagaacggaatcctggaaggaatcggagtcaagacagcactgtcgttccagaagtaccagatcgacgaactgggaaaggaaatcagaccgtgcagactgaagaagagaccgccggtcagatccggaaagagaacagcagacggatcggaattcgaatcgccgaagaagaagagaaaggtcgaatga

SEQ ID NO: 66 - DNA, 3306 bp, Artificial Sequence
  Synthetic: ORF encoding Neisseria meningitidis Cas9 (no start or stop codons; suitable for inclusion in fusion protein coding sequence)
gcagcattcaagccgaactcgatcaactacatcctgggactggacatcggaatcgcatcggtcggatgggcaatggtcgaaatcgacgaagaagaaaacccgatcagactgatcgacctgggagtcagagtcttcgaaagagcagaagtcccgaagacaggagactcgctggcaatggcaagaagactggcaagatcggtcagaagactgacaagaagaagagcacacagactgctgagaacaagaagactgctgaagagagaaggagtcctgcaggcagcaaacttcgacgaaaacggactgatcaagtcgctgccgaacacaccgtggcagctgagagcagcagcactggacagaaagctgacaccgctggaatggtcggcagtcctgctgcacctgatcaagcacagaggatacctgtcgcagagaaagaacgaaggagaaacagcagacaaggaactgggagcactgctgaagggagtcgcaggaaacgcacacgcactgcagacaggagacttcagaacaccggcagaactggcactgaacaagttcgaaaaggaatcgggacacatcagaaaccagagatcggactactcgcacacattctcgagaaaggacctgcaggcagaactgatcctgctgttcgaaaagcagaaggaattcggaaacccgcacgtctcgggaggactgaaggaaggaatcgaaacactgctgatgacacagagaccggcactgtcgggagacgcagtccagaagatgctgggacactgcacattcgaaccggcagaaccgaaggcagcaaagaacacatacacagcagaaagattcatctggctgacaaagctgaacaacctgagaatcctggaacagggatcggaaagaccgctgacagacacagaaagagcaacactgatggacgaaccgtacagaaagtcgaagctgacatacgcacaggcaagaaagctgctgggactggaagacacagcattcttcaagggactgagatacggaaaggacaacgcagaagcatcgacactgatggaaatgaaggcataccacgcaatctcgagagcactggaaaaggaaggactgaaggacaagaagtcgccgctgaacctgtcgccggaactgcaggacgaaatcggaacagcattctcgctgttcaagacagacgaagacatcacaggaagactgaaggacagaatccagccggaaatcctggaagcactgctgaagcacatctcgttcgacaagttcgtccagatctcgctgaaggcactgagaagaatcgtcccgctgatggaacagggaaagagatacgacgaagcatgcgcagaaatctacggagaccactacggaaagaagaacacagaagaaaagatctacctgccgccgatcccggcagacgaaatcagaaacccggtcgtcctgagagcactgtcgcaggcaagaaaggtcatcaacggagtcgtcagaagatacggatcgccggcaagaatccacatcgaaacagcaagagaagtcggaaagtcgttcaaggacagaaaggaaatcgaaaagagacaggaagaaaacagaaaggacagagaaaaggcagcagcaaagttcagagaatacttcccgaacttcgtcggagaaccgaagtcgaaggacatcctgaagctgagactgtacgaacagcagcacggaaagtgcctgtactcgggaaaggaaatcaacctgggaagactgaacgaaaagggatacgtcgaaatcgaccacgcactgccgttctcgagaacatgggacgactcgttcaacaacaaggtcctggtcctgggatcggaaaaccagaacaagggaaaccagacaccgtacgaatacttcaacggaaaggacaactcgagagaatggcaggaattcaaggcaagagtcgaaacatcgagattcccgagatcgaagaagcagagaatcctgctgcagaagttcgacgaagacggattcaaggaaagaaacctgaacgacacaagatacgtcaacagattcctgtgccagttcgtcgcagacagaatgagactgacaggaaagggaaagaagagagtcttcgcatcgaacggacagatcacaaacctgctgagaggattctggggactgagaaaggtcagagcagaaaacgacagacaccacgcactggacgcagtcgtcgtcgcatgctcgacagtcgcaatgcagcagaagatcacaagattcgtcagatacaaggaaatgaacgcattcgacggaaagacaatcgacaaggaaacaggagaagtcctgcaccagaagacacacttcccgcagccgtgggaattcttcgcacaggaagtcatgatcagagtcttcggaaagccggacggaaagccggaattcgaagaagcagacacactggaaaagctgagaacactgctggcagaaaagctgtcgtcgagaccggaagcagtccacgaatacgtcacaccgctgttcgtctcgagagcaccgaacagaaagatgtcgggacagggacacatggaaacagtcaagtcggcaaagagactggacgaaggagtctcggtcctgagagtcccgctgacacagctgaagctgaaggacctggaaaagatggtcaacagagaaagagaaccgaagctgtacgaagcactgaaggcaagactggaagcacacaaggacgacccggcaaaggcattcgcagaaccgttctacaagtacgacaaggcaggaaacagaacacagcaggtcaaggcagtcagagtcgaacaggtccagaagacaggagtctgggtcagaaaccacaacggaatcgcagacaacgcaacaatggtcagagtagacgtcttcgaaaagggagacaagtactacctggtcccgatctactcgtggcaggtcgcaaagggaatcctgccggacagagcagtcgtccagggaaaggacgaagaagactggcagctgatcgacgactcgttcaacttcaagttctcgctgcacccgaacgacctggtcgaagtcatcacaaagaaggcaagaatgttcggatacttcgcatcgtgccacagaggaacaggaaacatcaacatcagaatccacgacctggaccacaagatcggaaagaacggaatcctggaaggaatcggagtcaagacagcactgtcgttccagaagtaccagatcgacgaactgggaaaggaaatcagaccgtgcagactgaagaagagaccgccggtcagatccggaaagagaacagcagacggatcggaattcgaatcgccgaagaagaagagaaaggtcgaa

SEQ ID NO: 67 - DNA, 3636 bp, Artificial Sequence
  Synthetic: Transcript comprising SEQ ID NO: 65 (encoding Neisseria meningitidis Cas9)
gggagacccaagctggctagcgtttaaacttaagcttggatccgccaccatggcagcattcaagccgaactcgatcaactacatcctgggactggacatcggaatcgcatcggtcggatgggcaatggtcgaaatcgacgaagaagaaaacccgatcagactgatcgacctgggagtcagagtcttcgaaagagcagaagtcccgaagacaggagactcgctggcaatggcaagaagactggcaagatcggtcagaagactgacaagaagaagagcacacagactgctgagaacaagaagactgctgaagagagaaggagtcctgcaggcagcaaacttcgacgaaaacggactgatcaagtcgctgccgaacacaccgtggcagctgagagcagcagcactggacagaaagctgacaccgctggaatggtcggcagtcctgctgcacctgatcaagcacagaggatacctgtcgcagagaaagaacgaaggagaaacagcagacaaggaactgggagcactgctgaagggagtcgcaggaaacgcacacgcactgcagacaggagacttcagaacaccggcagaactggcactgaacaagttcgaaaaggaatcgggacacatcagaaaccagagatcggactactcgcacacattctcgagaaaggacctgcaggcagaactgatcctgctgttcgaaaagcagaaggaattcggaaacccgcacgtctcgggaggactgaaggaaggaatcgaaacactgctgatgacacagagaccggcactgtcgggagacgcagtccagaagatgctgggacactgcacattcgaaccggcagaaccgaaggcagcaaagaacacatacacagcagaaagattcatctggctgacaaagctgaacaacctgagaatcctggaacagggatcggaaagaccgctgacagacacagaaagagcaacactgatggacgaaccgtacagaaagtcgaagctgacatacgcacaggcaagaaagctgctgggactggaagacacagcattcttcaagggactgagatacggaaaggacaacgcagaagcatcgacactgatggaaatgaaggcataccacgcaatctcgagagcactggaaaaggaaggactgaaggacaagaagtcgccgctgaacctgtcgccggaactgcaggacgaaatcggaacagcattctcgctgttcaagacagacgaagacatcacaggaagactgaaggacagaatccagccggaaatcctggaagcactgctgaagcacatctcgttcgacaagttcgtccagatctcgctgaaggcactgagaagaatcgtcccgctgatggaacagggaaagagatacgacgaagcatgcgcagaaatctacggagaccactacggaaagaagaacacagaagaaaagatctacctgccgccgatcccggcagacgaaatcagaaacccggtcgtcctgagagcactgtcgcaggcaagaaaggtcatcaacggagtcgtcagaagatacggatcgccggcaagaatccacatcgaaacagcaagagaagtcggaaagtcgttcaaggacagaaaggaaatcgaaaagagacaggaagaaaacagaaaggacagagaaaaggcagcagcaaagttcagagaatacttcccgaacttcgtcggagaaccgaagtcgaaggacatcctgaagctgagactgtacgaacagcagcacggaaagtgcctgtactcgggaaaggaaatcaacctgggaagactgaacgaaaagggatacgtcgaaatcgaccacgcactgccgttctcgagaacatgggacgactcgttcaacaacaaggtcctggtcctgggatcggaaaaccagaacaagggaaaccagacaccgtacgaatacttcaacggaaaggacaactcgagagaatggcaggaattcaaggcaagagtcgaaacatcgagattcccgagatcgaagaagcagagaatcctgctgcagaagttcgacgaagacggattcaaggaaagaaacctgaacgacacaagatacgtcaacagattcctgtgccagttcgtcgcagacagaatgagactgacaggaaagggaaagaagagagtcttcgcatcgaacggacagatcacaaacctgctgagaggattctggggactgagaaaggtcagagcagaaaacgacagacaccacgcactggacgcagtcgtcgtcgcatgctcgacagtcgcaatgcagcagaagatcacaagattcgtcagatacaaggaaatgaacgcattcgacggaaagacaatcgacaaggaaacaggagaagtcctgcaccagaagacacacttcccgcagccgtgggaattcttcgcacaggaagtcatgatcagagtcttcggaaagccggacggaaagccggaattcgaagaagcagacacactggaaaagctgagaacactgctggcagaaaagctgtcgtcgagaccggaagcagtccacgaatacgtcacaccgctgttcgtctcgagagcaccgaacagaaagatgtcgggacagggacacatggaaacagtcaagtcggcaaagagactggacgaaggagtctcggtcctgagagtcccgctgacacagctgaagctgaaggacctggaaaagatggtcaacagagaaagagaaccgaagctgtacgaagcactgaaggcaagactggaagcacacaaggacgacccggcaaaggcattcgcagaaccgttctacaagtacgacaaggcaggaaacagaacacagcaggtcaaggcagtcagagtcgaacaggtccagaagacaggagtctgggtcagaaaccacaacggaatcgcagacaacgcaacaatggtcagagtagacgtcttcgaaaagggagacaagtactacctggtcccgatctactcgtggcaggtcgcaaagggaatcctgccggacagagcagtcgtccagggaaaggacgaagaagactggcagctgatcgacgactcgttcaacttcaagttctcgctgcacccgaacgacctggtcgaagtcatcacaaagaaggcaagaatgttcggatacttcgcatcgtgccacagaggaacaggaaacatcaacatcagaatccacgacctggaccacaagatcggaaagaacggaatcctggaaggaatcggagtcaagacagcactgtcgttccagaagtaccagatcgacgaactgggaaaggaaatcagaccgtgcagactgaagaagagaccgccggtcagatccggaaagagaacagcagacggatcggaattcgaatcgccgaagaagaagagaaaggtcgaatgatagctagctcgagtctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgg

SEQ ID NO: 68 - protein, 1103 aa, Artificial Sequence
  Synthetic: Amino acid sequence of Neisseria meningitidis Cas9
MAAFKPNSINYILGLDIGIASVGWAMVEIDEEENPIRLIDLGVRVFERAEVPKTGDSLAMARRLARSVRRLTRRRAHRLLRTRRLLKREGVLQAANFDENGLIKSLPNTPWQLRAAALDRKLTPLEWSAVLLHLIKHRGYLSQRKNEGETADKELGALLKGVAGNAHALQTGDFRTPAELALNKFEKESGHIRNQRSDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTLEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVRSGKRTADGSEFESPKKKRKVE

SEQ ID NO: 69 - RNA, 100 nt, Artificial Sequence
  Synthetic: G390 guide RNA
  modified_base (1)..(3): PS linkage, 2'-O-Me nucleotide
  modified_base (29)..(40): 2'-O-Me nucleotide
  modified_base (69)..(96): 2'-O-Me nucleotide
  modified_base (97)..(100): PS linkage, 2'-O-Me nucleotide
gccgagucuggagagcugcaguuuuagagcuagaaauagcaaguuaaaauaaggcuaguccguuaucaacuugaaaaaguggcaccgagucggugcuuuu

SEQ ID NO: 70 - RNA, 100 nt, Artificial Sequence
  Synthetic: G502 guide RNA
  modified_base (1)..(3): PS linkage, 2'-O-Me nucleotide
  modified_base (29)..(40): 2'-O-Me nucleotide
  modified_base (69)..(96): 2'-O-Me nucleotide
  modified_base (97)..(100): PS linkage, 2'-O-Me nucleotide
acacaaauaccaguccagcgguuuuagagcuagaaauagcaaguuaaaauaaggcuaguccguuaucaacuugaaaaaguggcaccgagucggugcuuuu

SEQ ID NO: 71 - RNA, 100 nt, Artificial Sequence
  Synthetic: G509 guide RNA
  modified_base (1)..(3): PS linkage, 2'-O-Me nucleotide
  modified_base (29)..(40): 2'-O-Me nucleotide
  modified_base (69)..(96): 2'-O-Me nucleotide
  modified_base (97)..(100): PS linkage, 2'-O-Me nucleotide
aaaguucuagaugccguccgguuuuagagcuagaaauagcaaguuaaaauaaggcuaguccguuaucaacuugaaaaaguggcaccgagucggugcuuuu

SEQ ID NO: 72 - RNA, 100 nt, Artificial Sequence
  Synthetic: G534 guide RNA
  modified_base (1)..(3): PS linkage, 2'-O-Me nucleotide
  modified_base (29)..(40): 2'-O-Me nucleotide
  modified_base (69)..(96): 2'-O-Me nucleotide
  modified_base (97)..(100): PS linkage, 2'-O-Me nucleotide
acgcaaauaucaguccagcgguuuuagagcuagaaauagcaaguuaaaauaaggcuaguccguuaucaacuugaaaaaguggcaccgagucggugcuuuu

SEQ ID NO: 73 - DNA, 3783 bp, Artificial Sequence
  Synthetic: DNA coding sequence of eGFP
tcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattctaatacgactcactatagggtcccgcagtcggcgtccagcggctctgcttgttcgtgtgtgtgtcgttgcaggccttattcggatccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaataggaattatgcagtctagccatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctcgagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctagacttaagcttgatgagctctagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtcg

SEQ ID NO: 74 - RNA, 100 nt, Artificial Sequence
  Synthetic: Modified sgRNA pattern, where N are nucleotides encoding a guide seqnence
  misc_feature (1)..(20): n is a, c, g, or u
  modified_base (1)..(3): PS linkage, 2'-O-Me nucleotide
  modified_base (29)..(40): 2'-O-Me nucleotide
  modified_base (69)..(96): 2'-O-Me nucleotide
  modified_base (97)..(100): PS linkage, 2'-O-Me nucleotide
nnnnnnnnnnnnnnnnnnnnguuuuagagcuagaaauagcaaguuaaaauaaggcuaguccguuaucaacuugaaaaaguggcaccgagucggugcuuuu

SEQ ID NO: 75 - DNA, 42 bp, Artificial Sequence
  Synthetic: CMV-1 5 UTR
cagatcgcctggagacgccatccacgctgttttgacctccat

SEQ ID NO: 76 - DNA, 42 bp, Artificial Sequence
  Synthetic: CMV-2 5 UTR
agaagacaccgggaccgatccagcctccgcggccgggaacgg

SEQ ID NO: 77 - DNA, 42 bp, Artificial Sequence
  Synthetic: CMV-3 5 UTR
tgcattggaacgcggattccccgtgccaagagtgactcaccg

SEQ ID NO: 78 - protein, 7 aa, Artificial Sequence
  Synthetic: SV40 NLS
PKKKRKV

SEQ ID NO: 79 - protein, 9 aa, Artificial Sequence
  Synthetic: Exemplary NLS 1
LAAKRSRTT

SEQ ID NO: 80 - protein, 9 aa, Artificial Sequence
  Synthetic: Exemplary NLS 2
QAAKRSRTT

SEQ ID NO: 81 - protein, 10 aa, Artificial Sequence
  Synthetic: Exemplary NLS 3
PAPAKRERTT

SEQ ID NO: 82 - protein, 9 aa, Artificial Sequence
  Synthetic: Exemplary NLS 4
QAAKRPRTT

SEQ ID NO: 83 - protein, 9 aa, Artificial Sequence
  Synthetic: Exemplary NLS 5
RAAKRPRTT

SEQ ID NO: 84 - protein, 11 aa, Artificial Sequence
  Synthetic: Exemplary NLS 6
AAAKRSWSMAA

SEQ ID NO: 85 - protein, 11 aa, Artificial Sequence
  Synthetic: Exemplary NLS 7
AAAKRVWSMAF

SEQ ID NO: 86 - protein, 11 aa, Artificial Sequence
  Synthetic: Exemplary NLS 8
AAAKRSWSMAF

SEQ ID NO: 87 - protein, 10 aa, Artificial Sequence
  Synthetic: Exemplary NLS 9
AAAKRKYFAA

SEQ ID NO: 88 - protein, 10 aa, Artificial Sequence
  Synthetic: Exemplary NLS 10
RAAKRKAFAA

SEQ ID NO: 89 - protein, 10 aa, Artificial Sequence
  Synthetic: Exemplary NLS 11
RAAKRKYFAV

SEQ ID NO: 90 - protein, 7 aa, Artificial Sequence
  Synthetic: Alternate SV40 NLS
PKKKRRV

SEQ ID NO: 91 - protein, 16 aa, Artificial Sequence
  Synthetic: Nucleoplasmin NLS
KRPAATKKAGQAKKKK

SEQ ID NO: 92 - DNA, 21 bp, Artificial Sequence
  Synthetic: Exemplary coding sequence for SV40 NLS
ccgaagaagaagagaaaggtc

SEQ ID NO: 93 - DNA, 27 bp, Artificial Sequence
  Synthetic: Exemplary coding sequence for NLS1
ctggcagcaaagagaagcagaacaaca

SEQ ID NO: 94 - DNA, 27 bp, Artificial Sequence
  Synthetic: Exemplary coding sequence for NLS2
caggcagcaaagagaagcagaacaaca

SEQ ID NO: 95 - DNA, 30 bp, Artificial Sequence
  Synthetic: Exemplary coding sequence for NLS3
ccggcaccggcaaagagagaaagaacaaca

SEQ ID NO: 96 - DNA, 27 bp, Artificial Sequence
  Synthetic: Exemplary coding sequence for NLS4
caggcagcaaagagaccgagaacaaca

SEQ ID NO: 97 - DNA, 27 bp, Artificial Sequence
  Synthetic: Exemplary coding sequence for NLS5
agagcagcaaagagaccgagaacaaca

SEQ ID NO: 98 - DNA, 33 bp, Artificial Sequence
  Synthetic: Exemplary coding sequence for NLS6
gcagcagcaaagagaagctggagcatggcagca

SEQ ID NO: 99 - DNA, 33 bp, Artificial Sequence
  Synthetic: Exemplary coding sequence for NLS7
gcagcagcaaagagagtctggagcatggcattc

SEQ ID NO: 100 - DNA, 33 bp, Artificial Sequence
  Synthetic: Exemplary coding sequence for NLS8
gcagcagcaaagagaagctggagcatggcattc

SEQ ID NO: 101 - DNA, 30 bp, Artificial Sequence
  Synthetic: Exemplary coding sequence for NLS9
gcagcagcaaagagaaagtacttcgcagca

SEQ ID NO: 102 - DNA, 30 bp, Artificial Sequence
  Synthetic: Exemplary coding sequence for NLS10
agagcagcaaagagaaaggcattcgcagca

SEQ ID NO: 103 - DNA, 30 bp, Artificial Sequence
  Synthetic: Exemplary coding sequence for NLS11
agagcagcaaagagaaagtacttcgcagtc

SEQ ID NO: 104 - DNA, 21 bp, Artificial Sequence
  Synthetic: Exemplary coding sequence for alternate SV40 NLS
ccgaagaagaagagaagagtc

SEQ ID NO: 105 - RNA, 13 nt, Artificial Sequence
  Synthetic: exemplary Kozak sequence
gccgccrccaugg

SEQ ID NO: 106 - skipped

SEQ ID NO: 107 - DNA, 4140 bp, Artificial Sequence
  Synthetic: Cas9 ORF using long half life codons of Table 4, with start and stop codons
atggacaagaagtactctatcggtttggacatcggtaccaactctgtcggttgggccgtcatcaccgacgaatacaaggtcccatctaagaagttcaaggtcttgggtaacaccgacagacactctatcaagaagaacttgatcggtgccttgttgttcgactctggtgaaaccgccgaagccaccagattgaagagaaccgccagaagaagatacaccagaagaaagaacagaatctgctacttgcaagaaatcttctctaacgaaatggccaaggtcgacgactctttcttccacagattggaagaatctttcttggtcgaagaagacaagaagcacgaaagacacccaatcttcggtaacatcgtcgacgaagtcgcctaccacgaaaagtacccaaccatctaccacttgagaaagaagttggtcgactctaccgacaaggccgacttgagattgatctacttggccttggcccacatgatcaagttcagaggtcacttcttgatcgaaggtgacttgaacccagacaactctgacgtcgacaagttgttcatccaattggtccaaacctacaaccaattgttcgaagaaaacccaatcaacgcctctggtgtcgacgccaaggccatcttgtctgccagattgtctaagagcagaagattggaaaacttgatcgcccaattgccaggtgaaaagaagaacggtttgttcggtaacttgatcgccttgtctttgggtttgaccccaaacttcaagtctaacttcgacttggccgaagacgccaagttgcaattgtctaaggacacctacgacgacgacttggacaacttgttggcccaaatcggtgaccaatacgccgacttgttcttggccgccaagaacttgtctgacgccatcttgttgtctgacatcttgagagtcaacaccgaaatcaccaaggccccattgtctgcctctatgatcaagagatacgacgaacaccaccaagacttgaccttgttgaaggccttggtcagacaacaattgccagaaaagtacaaggaaatcttcttcgaccaatctaagaacggttacgccggttacatcgacggtggtgcctctcaagaagaattctacaagttcatcaagccaatcttggaaaagatggacggtaccgaagaattgttggtcaagttgaacagagaagacttgttgagaaagcaaagaaccttcgacaacggttctatcccacaccaaatccacttgggtgaattgcacgccatcttgagaagacaagaagacttctacccattcttgaaggacaacagagaaaagatcgaaaagatcttgaccttcagaatcccatactacgtcggtccattggccagaggtaacagcagattcgcctggatgaccagaaagtctgaagaaaccatcaccccatggaacttcgaagaagtcgtcgacaagggtgcctctgcccaatctttcatcgaaagaatgaccaacttcgacaagaacttgccaaacgaaaaggtcttgccaaagcactctttgttgtacgaatacttcaccgtctacaacgaattgaccaaggtcaagtacgtcaccgaaggtatgagaaagccagccttcttgtctggtgaacaaaagaaggccatcgtcgacttgttgttcaagaccaacagaaaggtcaccgtcaagcaattgaaggaagactacttcaagaagatcgaatgcttcgactctgtcgaaatctctggtgtcgaagacagattcaacgcctctttgggtacctaccacgacttgttgaagatcatcaaggacaaggacttcttggacaacgaagaaaacgaagacatcttggaagacatcgtcttgaccttgaccttgttcgaagacagagaaatgatcgaagaaagattgaagacctacgcccacttgttcgacgacaaggtcatgaagcaattgaagagaagaagatacaccggttggggtagattgagcagaaagttgatcaacggtatcagagacaagcaatctggtaagaccatcttggacttcttgaagtctgacggtttcgccaacagaaacttcatgcaattgatccacgacgactctttgaccttcaaggaagacatccaaaaggcccaagtctctggtcaaggtgactctttgcacgaacacatcgccaacttggccggttctccagccatcaagaagggtatcttgcaaaccgtcaaggtcgtcgacgaattggtcaaggtcatgggtagacacaagccagaaaacatcgtcatcgaaatggccagagaaaaccaaaccacccaaaagggtcaaaagaacagcagagaaagaatgaagagaatcgaagaaggtatcaaggaattgggttctcaaatcttgaaggaacacccagtcgaaaacacccaattgcaaaacgaaaagttgtacttgtactacttgcaaaacggtagagacatgtacgtcgaccaagaattggacatcaacagattgtctgactacgacgtcgaccacatcgtcccacaatctttcttgaaggacgactctatcgacaacaaggtcttgaccagatctgacaagaacagaggtaagtctgacaacgtcccatctgaagaagtcgtcaagaagatgaagaactactggagacaattgttgaacgccaagttgatcacccaaagaaagttcgacaacttgaccaaggccgaaagaggtggtttgtctgaattggacaaggccggtttcatcaagagacaattggtcgaaaccagacaaatcaccaagcacgtcgcccaaatcttggacagcagaatgaacaccaagtacgacgaaaacgacaagttgatcagagaagtcaaggtcatcaccttgaagtctaagttggtctctgacttcagaaaggacttccaattctacaaggtcagagaaatcaacaactaccaccacgcccacgacgcctacttgaacgccgtcgtcggtaccgccttgatcaagaagtacccaaagttggaatctgaattcgtctacggtgactacaaggtctacgacgtcagaaagatgatcgccaagtctgaacaagaaatcggtaaggccaccgccaagtacttcttctactctaacatcatgaacttcttcaagaccgaaatcaccttggccaacggtgaaatcagaaagagaccattgatcgaaaccaacggtgaaaccggtgaaatcgtctgggacaagggtagagacttcgccaccgtcagaaaggtcttgtctatgccacaagtcaacatcgtcaagaagaccgaagtccaaaccggtggtttctctaaggaatctatcttgccaaagagaaactctgacaagttgatcgccagaaagaaggactgggacccaaagaagtacggtggtttcgactctccaaccgtcgcctactctgtcttggtcgtcgccaaggtcgaaaagggtaagtctaagaagttgaagtctgtcaaggaattgttgggtatcaccatcatggaaagatcttctttcgaaaagaacccaatcgacttcttggaagccaagggttacaaggaagtcaagaaggacttgatcatcaagttgccaaagtactctttgttcgaattggaaaacggtagaaagagaatgttggcctctgccggtgaattgcaaaagggtaacgaattggccttgccatctaagtacgtcaacttcttgtacttggcctctcactacgaaaagttgaagggttctccagaagacaacgaacaaaagcaattgttcgtcgaacaacacaagcactacttggacgaaatcatcgaacaaatctctgaattctctaagagagtcatcttggccgacgccaacttggacaaggtcttgtctgcctacaacaagcacagagacaagccaatcagagaacaagccgaaaacatcatccacttgttcaccttgaccaacttgggtgccccagccgccttcaagtacttcgacaccaccatcgacagaaagagatacacctctaccaaggaagtcttggacgccaccttgatccaccaatctatcaccggtttgtacgaaaccagaatcgacttgtctcaattgggtggtgacggtggtggttctccaaagaagaagagaaaggtctaa

SEQ ID NO: 108 - DNA, 4140 bp, Artificial Sequence
  Synthetic: Cas9 ORF using U rich codons of Table 4, with start and stop codons
atggataaaaaatattctattggtttagatattggtactaattctgttggttgggctgttattactgatgaatataaagttccttctaaaaaatttaaagttttaggtaatactgatcgtcattctattaaaaaaaatttaattggtgctttattatttgattctggtgaaactgctgaagctactcgtttaaaacgtactgctcgtcgtcgttatactcgtcgtaaaaatcgtatttgttatttacaagaaattttttctaatgaaatggctaaagttgatgattctttttttcatcgtttagaagaatcttttttagttgaagaagataaaaaacatgaacgtcatcctatttttggtaatattgttgatgaagttgcttatcatgaaaaatatcctactatttatcatttacgtaaaaaattagttgattctactgataaagctgatttacgtttaatttatttagctttagctcatatgattaaatttcgtggtcattttttaattgaaggtgatttaaatcctgataattctgatgttgataaattatttattcaattagttcaaacttataatcaattatttgaagaaaatcctattaatgcttctggtgttgatgctaaagctattttatctgctcgtttatctaaatctcgtcgtttagaaaatttaattgctcaattacctggtgaaaaaaaaaatggtttatttggtaatttaattgctttatctttaggtttaactcctaattttaaatctaattttgatttagctgaagatgctaaattacaattatctaaagatacttatgatgatgatttagataatttattagctcaaattggtgatcaatatgctgatttatttttagctgctaaaaatttatctgatgctattttattatctgatattttacgtgttaatactgaaattactaaagctcctttatctgcttctatgattaaacgttatgatgaacatcatcaagatttaactttattaaaagctttagttcgtcaacaattacctgaaaaatataaagaaattttttttgatcaatctaaaaatggttatgctggttatattgatggtggtgcttctcaagaagaattttataaatttattaaacctattttagaaaaaatggatggtactgaagaattattagttaaattaaatcgtgaagatttattacgtaaacaacgtacttttgataatggttctattcctcatcaaattcatttaggtgaattacatgctattttacgtcgtcaagaagatttttatccttttttaaaagataatcgtgaaaaaattgaaaaaattttaacttttcgtattccttattatgttggtcctttagctcgtggtaattctcgttttgcttggatgactcgtaaatctgaagaaactattactccttggaattttgaagaagttgttgataaaggtgcttctgctcaatcttttattgaacgtatgactaattttgataaaaatttacctaatgaaaaagttttacctaaacattctttattatatgaatattttactgtttataatgaattaactaaagttaaatatgttactgaaggtatgcgtaaacctgcttttttatctggtgaacaaaaaaaagctattgttgatttattatttaaaactaatcgtaaagttactgttaaacaattaaaagaagattattttaaaaaaattgaatgttttgattctgttgaaatttctggtgttgaagatcgttttaatgcttctttaggtacttatcatgatttattaaaaattattaaagataaagattttttagataatgaagaaaatgaagatattttagaagatattgttttaactttaactttatttgaagatcgtgaaatgattgaagaacgtttaaaaacttatgctcatttatttgatgataaagttatgaaacaattaaaacgtcgtcgttatactggttggggtcgtttatctcgtaaattaattaatggtattcgtgataaacaatctggtaaaactattttagattttttaaaatctgatggttttgctaatcgtaattttatgcaattaattcatgatgattctttaacttttaaagaagatattcaaaaagctcaagtttctggtcaaggtgattctttacatgaacatattgctaatttagctggttctcctgctattaaaaaaggtattttacaaactgttaaagttgttgatgaattagttaaagttatgggtcgtcataaacctgaaaatattgttattgaaatggctcgtgaaaatcaaactactcaaaaaggtcaaaaaaattctcgtgaacgtatgaaacgtattgaagaaggtattaaagaattaggttctcaaattttaaaagaacatcctgttgaaaatactcaattacaaaatgaaaaattatatttatattatttacaaaatggtcgtgatatgtatgttgatcaagaattagatattaatcgtttatctgattatgatgttgatcatattgttcctcaatcttttttaaaagatgattctattgataataaagttttaactcgttctgataaaaatcgtggtaaatctgataatgttccttctgaagaagttgttaaaaaaatgaaaaattattggcgtcaattattaaatgctaaattaattactcaacgtaaatttgataatttaactaaagctgaacgtggtggtttatctgaattagataaagctggttttattaaacgtcaattagttgaaactcgtcaaattactaaacatgttgctcaaattttagattctcgtatgaatactaaatatgatgaaaatgataaattaattcgtgaagttaaagttattactttaaaatctaaattagtttctgattttcgtaaagattttcaattttataaagttcgtgaaattaataattatcatcatgctcatgatgcttatttaaatgctgttgttggtactgctttaattaaaaaatatcctaaattagaatctgaatttgtttatggtgattataaagtttatgatgttcgtaaaatgattgctaaatctgaacaagaaattggtaaagctactgctaaatattttttttattctaatattatgaatttttttaaaactgaaattactttagctaatggtgaaattcgtaaacgtcctttaattgaaactaatggtgaaactggtgaaattgtttgggataaaggtcgtgattttgctactgttcgtaaagttttatctatgcctcaagttaatattgttaaaaaaactgaagttcaaactggtggtttttctaaagaatctattttacctaaacgtaattctgataaattaattgctcgtaaaaaagattgggatcctaaaaaatatggtggttttgattctcctactgttgcttattctgttttagttgttgctaaagttgaaaaaggtaaatctaaaaaattaaaatctgttaaagaattattaggtattactattatggaacgttcttcttttgaaaaaaatcctattgattttttagaagctaaaggttataaagaagttaaaaaagatttaattattaaattacctaaatattctttatttgaattagaaaatggtcgtaaacgtatgttagcttctgctggtgaattacaaaaaggtaatgaattagctttaccttctaaatatgttaattttttatatttagcttctcattatgaaaaattaaaaggttctcctgaagataatgaacaaaaacaattatttgttgaacaacataaacattatttagatgaaattattgaacaaatttctgaattttctaaacgtgttattttagctgatgctaatttagataaagttttatctgcttataataaacatcgtgataaacctattcgtgaacaagctgaaaatattattcatttatttactttaactaatttaggtgctcctgctgcttttaaatattttgatactactattgatcgtaaacgttatacttctactaaagaagttttagatgctactttaattcatcaatctattactggtttatatgaaactcgtattgatttatctcaattaggtggtgatggtggtggttctcctaaaaaaaaacgtaaagtttga

SEQ ID NO: 109 - DNA, 4140 bp, Artificial Sequence
  Synthetic: Cas9 ORF using low G codons of Table 4, with start and stop codons
atggacaaaaaatactccatcggcctcgacatcggcaccaactccgtcggctgggccgtcatcaccgacgaatacaaagtcccctccaaaaaattcaaagtcctcggcaacaccgacagacactccatcaaaaaaaacctcatcggcgccctcctcttcgactccggcgaaaccgccgaagccaccagactcaaaagaaccgccagaagaagatacaccagaagaaaaaacagaatctgctacctccaagaaatcttctccaacgaaatggccaaagtcgacgactccttcttccacagactcgaagaatccttcctcgtcgaagaagacaaaaaacacgaaagacaccccatcttcggcaacatcgtcgacgaagtcgcctaccacgaaaaataccccaccatctaccacctcagaaaaaaactcgtcgactccaccgacaaagccgacctcagactcatctacctcgccctcgcccacatgatcaaattcagaggccacttcctcatcgaaggcgacctcaaccccgacaactccgacgtcgacaaactcttcatccaactcgtccaaacctacaaccaactcttcgaagaaaaccccatcaacgcctccggcgtcgacgccaaagccatcctctccgccagactctccaaatccagaagactcgaaaacctcatcgcccaactccccggcgaaaaaaaaaacggcctcttcggcaacctcatcgccctctccctcggcctcacccccaacttcaaatccaacttcgacctcgccgaagacgccaaactccaactctccaaagacacctacgacgacgacctcgacaacctcctcgcccaaatcggcgaccaatacgccgacctcttcctcgccgccaaaaacctctccgacgccatcctcctctccgacatcctcagagtcaacaccgaaatcaccaaagcccccctctccgcctccatgatcaaaagatacgacgaacaccaccaagacctcaccctcctcaaagccctcgtcagacaacaactccccgaaaaatacaaagaaatcttcttcgaccaatccaaaaacggctacgccggctacatcgacggcggcgcctcccaagaagaattctacaaattcatcaaacccatcctcgaaaaaatggacggcaccgaagaactcctcgtcaaactcaacagagaagacctcctcagaaaacaaagaaccttcgacaacggctccatcccccaccaaatccacctcggcgaactccacgccatcctcagaagacaagaagacttctaccccttcctcaaagacaacagagaaaaaatcgaaaaaatcctcaccttcagaatcccctactacgtcggccccctcgccagaggcaactccagattcgcctggatgaccagaaaatccgaagaaaccatcaccccctggaacttcgaagaagtcgtcgacaaaggcgcctccgcccaatccttcatcgaaagaatgaccaacttcgacaaaaacctccccaacgaaaaagtcctccccaaacactccctcctctacgaatacttcaccgtctacaacgaactcaccaaagtcaaatacgtcaccgaaggcatgagaaaacccgccttcctctccggcgaacaaaaaaaagccatcgtcgacctcctcttcaaaaccaacagaaaagtcaccgtcaaacaactcaaagaagactacttcaaaaaaatcgaatgcttcgactccgtcgaaatctccggcgtcgaagacagattcaacgcctccctcggcacctaccacgacctcctcaaaatcatcaaagacaaagacttcctcgacaacgaagaaaacgaagacatcctcgaagacatcgtcctcaccctcaccctcttcgaagacagagaaatgatcgaagaaagactcaaaacctacgcccacctcttcgacgacaaagtcatgaaacaactcaaaagaagaagatacaccggctggggcagactctccagaaaactcatcaacggcatcagagacaaacaatccggcaaaaccatcctcgacttcctcaaatccgacggcttcgccaacagaaacttcatgcaactcatccacgacgactccctcaccttcaaagaagacatccaaaaagcccaagtctccggccaaggcgactccctccacgaacacatcgccaacctcgccggctcccccgccatcaaaaaaggcatcctccaaaccgtcaaagtcgtcgacgaactcgtcaaagtcatgggcagacacaaacccgaaaacatcgtcatcgaaatggccagagaaaaccaaaccacccaaaaaggccaaaaaaactccagagaaagaatgaaaagaatcgaagaaggcatcaaagaactcggctcccaaatcctcaaagaacaccccgtcgaaaacacccaactccaaaacgaaaaactctacctctactacctccaaaacggcagagacatgtacgtcgaccaagaactcgacatcaacagactctccgactacgacgtcgaccacatcgtcccccaatccttcctcaaagacgactccatcgacaacaaagtcctcaccagatccgacaaaaacagaggcaaatccgacaacgtcccctccgaagaagtcgtcaaaaaaatgaaaaactactggagacaactcctcaacgccaaactcatcacccaaagaaaattcgacaacctcaccaaagccgaaagaggcggcctctccgaactcgacaaagccggcttcatcaaaagacaactcgtcgaaaccagacaaatcaccaaacacgtcgcccaaatcctcgactccagaatgaacaccaaatacgacgaaaacgacaaactcatcagagaagtcaaagtcatcaccctcaaatccaaactcgtctccgacttcagaaaagacttccaattctacaaagtcagagaaatcaacaactaccaccacgcccacgacgcctacctcaacgccgtcgtcggcaccgccctcatcaaaaaataccccaaactcgaatccgaattcgtctacggcgactacaaagtctacgacgtcagaaaaatgatcgccaaatccgaacaagaaatcggcaaagccaccgccaaatacttcttctactccaacatcatgaacttcttcaaaaccgaaatcaccctcgccaacggcgaaatcagaaaaagacccctcatcgaaaccaacggcgaaaccggcgaaatcgtctgggacaaaggcagagacttcgccaccgtcagaaaagtcctctccatgccccaagtcaacatcgtcaaaaaaaccgaagtccaaaccggcggcttctccaaagaatccatcctccccaaaagaaactccgacaaactcatcgccagaaaaaaagactgggaccccaaaaaatacggcggcttcgactcccccaccgtcgcctactccgtcctcgtcgtcgccaaagtcgaaaaaggcaaatccaaaaaactcaaatccgtcaaagaactcctcggcatcaccatcatggaaagatcctccttcgaaaaaaaccccatcgacttcctcgaagccaaaggctacaaagaagtcaaaaaagacctcatcatcaaactccccaaatactccctcttcgaactcgaaaacggcagaaaaagaatgctcgcctccgccggcgaactccaaaaaggcaacgaactcgccctcccctccaaatacgtcaacttcctctacctcgcctcccactacgaaaaactcaaaggctcccccgaagacaacgaacaaaaacaactcttcgtcgaacaacacaaacactacctcgacgaaatcatcgaacaaatctccgaattctccaaaagagtcatcctcgccgacgccaacctcgacaaagtcctctccgcctacaacaaacacagagacaaacccatcagagaacaagccgaaaacatcatccacctcttcaccctcaccaacctcggcgcccccgccgccttcaaatacttcgacaccaccatcgacagaaaaagatacacctccaccaaagaagtcctcgacgccaccctcatccaccaatccatcaccggcctctacgaaaccagaatcgacctctcccaactcggcggcgacggcggcggctcccccaaaaaaaaaagaaaagtctga

SEQ ID NO: 110 - DNA, 4140 bp, Artificial Sequence
  Synthetic: Cas9 ORF using low C codons of Table 4, with start and stop codons
atggataagaagtatagtattggattggatattggaacaaatagtgtgggatgggctgtgattacagatgagtataaggtgcctagtaagaagtttaaggtgttgggaaatacagatagacatagtattaagaagaatttgattggagctttgttgtttgatagtggagagacagctgaggctacaagattgaagagaacagctagaagaagatatacaagaagaaagaatagaatttgttatttgcaggagatttttagtaatgagatggctaaggtggatgatagtttttttcatagattggaggagagttttttggtggaggaggataagaagcatgagagacatcctatttttggaaatattgtggatgaggtggcttatcatgagaagtatcctacaatttatcatttgagaaagaagttggtggatagtacagataaggctgatttgagattgatttatttggctttggctcatatgattaagtttagaggacattttttgattgagggagatttgaatcctgataatagtgatgtggataagttgtttattcagttggtgcagacatataatcagttgtttgaggagaatcctattaatgctagtggagtggatgctaaggctattttgagtgctagattgagtaagagtagaagattggagaatttgattgctcagttgcctggagagaagaagaatggattgtttggaaatttgattgctttgagtttgggattgacacctaattttaagagtaattttgatttggctgaggatgctaagttgcagttgagtaaggatacatatgatgatgatttggataatttgttggctcagattggagatcagtatgctgatttgtttttggctgctaagaatttgagtgatgctattttgttgagtgatattttgagagtgaatacagagattacaaaggctcctttgagtgctagtatgattaagagatatgatgagcatcatcaggatttgacattgttgaaggctttggtgagacagcagttgcctgagaagtataaggagattttttttgatcagagtaagaatggatatgctggatatattgatggaggagctagtcaggaggagttttataagtttattaagcctattttggagaagatggatggaacagaggagttgttggtgaagttgaatagagaggatttgttgagaaagcagagaacatttgataatggaagtattcctcatcagattcatttgggagagttgcatgctattttgagaagacaggaggatttttatccttttttgaaggataatagagagaagattgagaagattttgacatttagaattccttattatgtgggacctttggctagaggaaatagtagatttgcttggatgacaagaaagagtgaggagacaattacaccttggaattttgaggaggtggtggataagggagctagtgctcagagttttattgagagaatgacaaattttgataagaatttgcctaatgagaaggtgttgcctaagcatagtttgttgtatgagtattttacagtgtataatgagttgacaaaggtgaagtatgtgacagagggaatgagaaagcctgcttttttgagtggagagcagaagaaggctattgtggatttgttgtttaagacaaatagaaaggtgacagtgaagcagttgaaggaggattattttaagaagattgagtgttttgatagtgtggagattagtggagtggaggatagatttaatgctagtttgggaacatatcatgatttgttgaagattattaaggataaggattttttggataatgaggagaatgaggatattttggaggatattgtgttgacattgacattgtttgaggatagagagatgattgaggagagattgaagacatatgctcatttgtttgatgataaggtgatgaagcagttgaagagaagaagatatacaggatggggaagattgagtagaaagttgattaatggaattagagataagcagagtggaaagacaattttggattttttgaagagtgatggatttgctaatagaaattttatgcagttgattcatgatgatagtttgacatttaaggaggatattcagaaggctcaggtgagtggacagggagatagtttgcatgagcatattgctaatttggctggaagtcctgctattaagaagggaattttgcagacagtgaaggtggtggatgagttggtgaaggtgatgggaagacataagcctgagaatattgtgattgagatggctagagagaatcagacaacacagaagggacagaagaatagtagagagagaatgaagagaattgaggagggaattaaggagttgggaagtcagattttgaaggagcatcctgtggagaatacacagttgcagaatgagaagttgtatttgtattatttgcagaatggaagagatatgtatgtggatcaggagttggatattaatagattgagtgattatgatgtggatcatattgtgcctcagagttttttgaaggatgatagtattgataataaggtgttgacaagaagtgataagaatagaggaaagagtgataatgtgcctagtgaggaggtggtgaagaagatgaagaattattggagacagttgttgaatgctaagttgattacacagagaaagtttgataatttgacaaaggctgagagaggaggattgagtgagttggataaggctggatttattaagagacagttggtggagacaagacagattacaaagcatgtggctcagattttggatagtagaatgaatacaaagtatgatgagaatgataagttgattagagaggtgaaggtgattacattgaagagtaagttggtgagtgattttagaaaggattttcagttttataaggtgagagagattaataattatcatcatgctcatgatgcttatttgaatgctgtggtgggaacagctttgattaagaagtatcctaagttggagagtgagtttgtgtatggagattataaggtgtatgatgtgagaaagatgattgctaagagtgagcaggagattggaaaggctacagctaagtattttttttatagtaatattatgaatttttttaagacagagattacattggctaatggagagattagaaagagacctttgattgagacaaatggagagacaggagagattgtgtgggataagggaagagattttgctacagtgagaaaggtgttgagtatgcctcaggtgaatattgtgaagaagacagaggtgcagacaggaggatttagtaaggagagtattttgcctaagagaaatagtgataagttgattgctagaaagaaggattgggatcctaagaagtatggaggatttgatagtcctacagtggcttatagtgtgttggtggtggctaaggtggagaagggaaagagtaagaagttgaagagtgtgaaggagttgttgggaattacaattatggagagaagtagttttgagaagaatcctattgattttttggaggctaagggatataaggaggtgaagaaggatttgattattaagttgcctaagtatagtttgtttgagttggagaatggaagaaagagaatgttggctagtgctggagagttgcagaagggaaatgagttggctttgcctagtaagtatgtgaattttttgtatttggctagtcattatgagaagttgaagggaagtcctgaggataatgagcagaagcagttgtttgtggagcagcataagcattatttggatgagattattgagcagattagtgagtttagtaagagagtgattttggctgatgctaatttggataaggtgttgagtgcttataataagcatagagataagcctattagagagcaggctgagaatattattcatttgtttacattgacaaatttgggagctcctgctgcttttaagtattttgatacaacaattgatagaaagagatatacaagtacaaaggaggtgttggatgctacattgattcatcagagtattacaggattgtatgagacaagaattgatttgagtcagttgggaggagatggaggaggaagtcctaagaagaagagaaaggtgtga

SEQ ID NO: 111 - DNA, 4140 bp, Artificial Sequence
  Synthetic: Cas9 ORF using low A codons of Table 4, with start and stop codons
atggacaagaagtactccatcggcctggacatcggcaccaactccgtgggctgggccgtgatcaccgacgagtacaaggtgccctccaagaagttcaaggtgctgggcaacaccgaccggcactccatcaagaagaacctgatcggcgccctgctgttcgactccggcgagaccgccgaggccacccggctgaagcggaccgcccggcggcggtacacccggcggaagaaccggatctgctacctgcaggagatcttctccaacgagatggccaaggtggacgactccttcttccaccggctggaggagtccttcctggtggaggaggacaagaagcacgagcggcaccccatcttcggcaacatcgtggacgaggtggcctaccacgagaagtaccccaccatctaccacctgcggaagaagctggtggactccaccgacaaggccgacctgcggctgatctacctggccctggcccacatgatcaagttccggggccacttcctgatcgagggcgacctgaaccccgacaactccgacgtggacaagctgttcatccagctggtgcagacctacaaccagctgttcgaggagaaccccatcaacgcctccggcgtggacgccaaggccatcctgtccgcccggctgtccaagtcccggcggctggagaacctgatcgcccagctgcccggcgagaagaagaacggcctgttcggcaacctgatcgccctgtccctgggcctgacccccaacttcaagtccaacttcgacctggccgaggacgccaagctgcagctgtccaaggacacctacgacgacgacctggacaacctgctggcccagatcggcgaccagtacgccgacctgttcctggccgccaagaacctgtccgacgccatcctgctgtccgacatcctgcgggtgaacaccgagatcaccaaggcccccctgtccgcctccatgatcaagcggtacgacgagcaccaccaggacctgaccctgctgaaggccctggtgcggcagcagctgcccgagaagtacaaggagatcttcttcgaccagtccaagaacggctacgccggctacatcgacggcggcgcctcccaggaggagttctacaagttcatcaagcccatcctggagaagatggacggcaccgaggagctgctggtgaagctgaaccgggaggacctgctgcggaagcagcggaccttcgacaacggctccatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaactcccggttcgcctggatgacccggaagtccgaggagaccatcaccccctggaacttcgaggaggtggtggacaagggcgcctccgcccagtccttcatcgagcggatgaccaacttcgacaagaacctgcccaacgagaaggtgctgcccaagcactccctgctgtacgagtacttcaccgtgtacaacgagctgaccaaggtgaagtacgtgaccgagggcatgcggaagcccgccttcctgtccggcgagcagaagaaggccatcgtggacctgctgttcaagaccaaccggaaggtgaccgtgaagcagctgaaggaggactacttcaagaagatcgagtgcttcgactccgtggagatctccggcgtggaggaccggttcaacgcctccctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgtcccggaagctgatcaacggcatccgggacaagcagtccggcaagaccatcctggacttcctgaagtccgacggcttcgccaaccggaacttcatgcagctgatccacgacgactccctgaccttcaaggaggacatccagaaggcccaggtgtccggccagggcgactccctgcacgagcacatcgccaacctggccggctcccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaactcccgggagcggatgaagcggatcgaggagggcatcaaggagctgggctcccagatcctgaaggagcaccccgtggagaacacccagctgcagaacgagaagctgtacctgtactacctgcagaacggccgggacatgtacgtggaccaggagctggacatcaaccggctgtccgactacgacgtggaccacatcgtgccccagtccttcctgaaggacgactccatcgacaacaaggtgctgacccggtccgacaagaaccggggcaagtccgacaacgtgccctccgaggaggtggtgaagaagatgaagaactactggcggcagctgctgaacgccaagctgatcacccagcggaagttcgacaacctgaccaaggccgagcggggcggcctgtccgagctggacaaggccggcttcatcaagcggcagctggtggagacccggcagatcaccaagcacgtggcccagatcctggactcccggatgaacaccaagtacgacgagaacgacaagctgatccgggaggtgaaggtgatcaccctgaagtccaagctggtgtccgacttccggaaggacttccagttctacaaggtgcgggagatcaacaactaccaccacgcccacgacgcctacctgaacgccgtggtgggcaccgccctgatcaagaagtaccccaagctggagtccgagttcgtgtacggcgactacaaggtgtacgacgtgcggaagatgatcgccaagtccgagcaggagatcggcaaggccaccgccaagtacttcttctactccaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgtccatgccccaggtgaacatcgtgaagaagaccgaggtgcagaccggcggcttctccaaggagtccatcctgcccaagcggaactccgacaagctgatcgcccggaagaaggactgggaccccaagaagtacggcggcttcgactcccccaccgtggcctactccgtgctggtggtggccaaggtggagaagggcaagtccaagaagctgaagtccgtgaaggagctgctgggcatcaccatcatggagcggtcctccttcgagaagaaccccatcgacttcctggaggccaagggctacaaggaggtgaagaaggacctgatcatcaagctgcccaagtactccctgttcgagctggagaacggccggaagcggatgctggcctccgccggcgagctgcagaagggcaacgagctggccctgccctccaagtacgtgaacttcctgtacctggcctcccactacgagaagctgaagggctcccccgaggacaacgagcagaagcagctgttcgtggagcagcacaagcactacctggacgagatcatcgagcagatctccgagttctccaagcgggtgatcctggccgacgccaacctggacaaggtgctgtccgcctacaacaagcaccgggacaagcccatccgggagcaggccgagaacatcatccacctgttcaccctgaccaacctgggcgcccccgccgccttcaagtacttcgacaccaccatcgaccggaagcggtacacctccaccaaggaggtgctggacgccaccctgatccaccagtccatcaccggcctgtacgagacccggatcgacctgtcccagctgggcggcgacggcggcggctcccccaagaagaagcggaaggtgtga

SEQ ID NO: 112 - DNA, 4140 bp, Artificial Sequence
  Synthetic: Cas9 ORF using low A/U codons of Table 4, with start and stop codons
atggacaagaagtacagcatcggcctggacatcggcaccaacagcgtgggctgggccgtgatcaccgacgagtacaaggtgcccagcaagaagttcaaggtgctgggcaacaccgaccggcacagcatcaagaagaacctgatcggcgccctgctgttcgacagcggcgagaccgccgaggccacccggctgaagcggaccgcccggcggcggtacacccggcggaagaaccggatctgctacctgcaggagatcttcagcaacgagatggccaaggtggacgacagcttcttccaccggctggaggagagcttcctggtggaggaggacaagaagcacgagcggcaccccatcttcggcaacatcgtggacgaggtggcctaccacgagaagtaccccaccatctaccacctgcggaagaagctggtggacagcaccgacaaggccgacctgcggctgatctacctggccctggcccacatgatcaagttccggggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccggctgagcaagagccggcggctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgggtgaacaccgagatcaccaaggcccccctgagcgccagcatgatcaagcggtacgacgagcaccaccaggacctgaccctgctgaaggccctggtgcggcagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgggaggacctgctgcggaagcagcggaccttcgacaacggcagcatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaacagccggttcgcctggatgacccggaagagcgaggagaccatcaccccctggaacttcgaggaggtggtggacaagggcgccagcgcccagagcttcatcgagcggatgaccaacttcgacaagaacctgcccaacgagaaggtgctgcccaagcacagcctgctgtacgagtacttcaccgtgtacaacgagctgaccaaggtgaagtacgtgaccgagggcatgcggaagcccgccttcctgagcggcgagcagaagaaggccatcgtggacctgctgttcaagaccaaccggaaggtgaccgtgaagcagctgaaggaggactacttcaagaagatcgagtgcttcgacagcgtggagatcagcggcgtggaggaccggttcaacgccagcctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgagccggaagctgatcaacggcatccgggacaagcagagcggcaagaccatcctggacttcctgaagagcgacggcttcgccaaccggaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaacagccgggagcggatgaagcggatcgaggagggcatcaaggagctgggcagccagatcctgaaggagcaccccgtggagaacacccagctgcagaacgagaagctgtacctgtactacctgcagaacggccgggacatgtacgtggaccaggagctggacatcaaccggctgagcgactacgacgtggaccacatcgtgccccagagcttcctgaaggacgacagcatcgacaacaaggtgctgacccggagcgacaagaaccggggcaagagcgacaacgtgcccagcgaggaggtggtgaagaagatgaagaactactggcggcagctgctgaacgccaagctgatcacccagcggaagttcgacaacctgaccaaggccgagcggggcggcctgagcgagctggacaaggccggcttcatcaagcggcagctggtggagacccggcagatcaccaagcacgtggcccagatcctggacagccggatgaacaccaagtacgacgagaacgacaagctgatccgggaggtgaaggtgatcaccctgaagagcaagctggtgagcgacttccggaaggacttccagttctacaaggtgcgggagatcaacaactaccaccacgcccacgacgcctacctgaacgccgtggtgggcaccgccctgatcaagaagtaccccaagctggagagcgagttcgtgtacggcgactacaaggtgtacgacgtgcggaagatgatcgccaagagcgagcaggagatcggcaaggccaccgccaagtacttcttctacagcaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgagcatgccccaggtgaacatcgtgaagaagaccgaggtgcagaccggcggcttcagcaaggagagcatcctgcccaagcggaacagcgacaagctgatcgcccggaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcggagcagcttcgagaagaaccccatcgacttcctggaggccaagggctacaaggaggtgaagaaggacctgatcatcaagctgcccaagtacagcctgttcgagctggagaacggccggaagcggatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgggtgatcctggccgacgccaacctggacaaggtgctgagcgcctacaacaagcaccgggacaagcccatccgggagcaggccgagaacatcatccacctgttcaccctgaccaacctgggcgcccccgccgccttcaagtacttcgacaccaccatcgaccggaagcggtacaccagcaccaaggaggtgctggacgccaccctgatccaccagagcatcaccggcctgtacgagacccggatcgacctgagccagctgggcggcgacggcggcggcagccccaagaagaagcggaaggtgtga

SEQ ID NO: 113 - DNA, 4179 bp, Artificial Sequence
  Synthetic: Cas9 ORF using low A codons of Table 4, with two C-terminal NLS sequences and start and stop codons
atggacaagaagtactccatcggcctggacatcggcaccaactccgtgggctgggccgtgatcaccgacgagtacaaggtgccctccaagaagttcaaggtgctgggcaacaccgaccggcactccatcaagaagaacctgatcggcgccctgctgttcgactccggcgagaccgccgaggccacccggctgaagcggaccgcccggcggcggtacacccggcggaagaaccggatctgctacctgcaggagatcttctccaacgagatggccaaggtggacgactccttcttccaccggctggaggagtccttcctggtggaggaggacaagaagcacgagcggcaccccatcttcggcaacatcgtggacgaggtggcctaccacgagaagtaccccaccatctaccacctgcggaagaagctggtggactccaccgacaaggccgacctgcggctgatctacctggccctggcccacatgatcaagttccggggccacttcctgatcgagggcgacctgaaccccgacaactccgacgtggacaagctgttcatccagctggtgcagacctacaaccagctgttcgaggagaaccccatcaacgcctccggcgtggacgccaaggccatcctgtccgcccggctgtccaagtcccggcggctggagaacctgatcgcccagctgcccggcgagaagaagaacggcctgttcggcaacctgatcgccctgtccctgggcctgacccccaacttcaagtccaacttcgacctggccgaggacgccaagctgcagctgtccaaggacacctacgacgacgacctggacaacctgctggcccagatcggcgaccagtacgccgacctgttcctggccgccaagaacctgtccgacgccatcctgctgtccgacatcctgcgggtgaacaccgagatcaccaaggcccccctgtccgcctccatgatcaagcggtacgacgagcaccaccaggacctgaccctgctgaaggccctggtgcggcagcagctgcccgagaagtacaaggagatcttcttcgaccagtccaagaacggctacgccggctacatcgacggcggcgcctcccaggaggagttctacaagttcatcaagcccatcctggagaagatggacggcaccgaggagctgctggtgaagctgaaccgggaggacctgctgcggaagcagcggaccttcgacaacggctccatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaactcccggttcgcctggatgacccggaagtccgaggagaccatcaccccctggaacttcgaggaggtggtggacaagggcgcctccgcccagtccttcatcgagcggatgaccaacttcgacaagaacctgcccaacgagaaggtgctgcccaagcactccctgctgtacgagtacttcaccgtgtacaacgagctgaccaaggtgaagtacgtgaccgagggcatgcggaagcccgccttcctgtccggcgagcagaagaaggccatcgtggacctgctgttcaagaccaaccggaaggtgaccgtgaagcagctgaaggaggactacttcaagaagatcgagtgcttcgactccgtggagatctccggcgtggaggaccggttcaacgcctccctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgtcccggaagctgatcaacggcatccgggacaagcagtccggcaagaccatcctggacttcctgaagtccgacggcttcgccaaccggaacttcatgcagctgatccacgacgactccctgaccttcaaggaggacatccagaaggcccaggtgtccggccagggcgactccctgcacgagcacatcgccaacctggccggctcccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaactcccgggagcggatgaagcggatcgaggagggcatcaaggagctgggctcccagatcctgaaggagcaccccgtggagaacacccagctgcagaacgagaagctgtacctgtactacctgcagaacggccgggacatgtacgtggaccaggagctggacatcaaccggctgtccgactacgacgtggaccacatcgtgccccagtccttcctgaaggacgactccatcgacaacaaggtgctgacccggtccgacaagaaccggggcaagtccgacaacgtgccctccgaggaggtggtgaagaagatgaagaactactggcggcagctgctgaacgccaagctgatcacccagcggaagttcgacaacctgaccaaggccgagcggggcggcctgtccgagctggacaaggccggcttcatcaagcggcagctggtggagacccggcagatcaccaagcacgtggcccagatcctggactcccggatgaacaccaagtacgacgagaacgacaagctgatccgggaggtgaaggtgatcaccctgaagtccaagctggtgtccgacttccggaaggacttccagttctacaaggtgcgggagatcaacaactaccaccacgcccacgacgcctacctgaacgccgtggtgggcaccgccctgatcaagaagtaccccaagctggagtccgagttcgtgtacggcgactacaaggtgtacgacgtgcggaagatgatcgccaagtccgagcaggagatcggcaaggccaccgccaagtacttcttctactccaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgtccatgccccaggtgaacatcgtgaagaagaccgaggtgcagaccggcggcttctccaaggagtccatcctgcccaagcggaactccgacaagctgatcgcccggaagaaggactgggaccccaagaagtacggcggcttcgactcccccaccgtggcctactccgtgctggtggtggccaaggtggagaagggcaagtccaagaagctgaagtccgtgaaggagctgctgggcatcaccatcatggagcggtcctccttcgagaagaaccccatcgacttcctggaggccaagggctacaaggaggtgaagaaggacctgatcatcaagctgcccaagtactccctgttcgagctggagaacggccggaagcggatgctggcctccgccggcgagctgcagaagggcaacgagctggccctgccctccaagtacgtgaacttcctgtacctggcctcccactacgagaagctgaagggctcccccgaggacaacgagcagaagcagctgttcgtggagcagcacaagcactacctggacgagatcatcgagcagatctccgagttctccaagcgggtgatcctggccgacgccaacctggacaaggtgctgtccgcctacaacaagcaccgggacaagcccatccgggagcaggccgagaacatcatccacctgttcaccctgaccaacctgggcgcccccgccgccttcaagtacttcgacaccaccatcgaccggaagcggtacacctccaccaaggaggtgctggacgccaccctgatccaccagtccatcaccggcctgtacgagacccggatcgacctgtcccagctgggcggcgacggctccggctcccccaagaagaagcggaaggtggacggctcccccaagaagaagcggaaggtggactccggctga

SEQ ID NO: 114 - DNA, 4140 bp, Artificial Sequence
  Synthetic: Cas9 nickase ORF using low A codons of Table 4, with start and stop codons
atggacaagaagtactccatcggcctggccatcggcaccaactccgtgggctgggccgtgatcaccgacgagtacaaggtgccctccaagaagttcaaggtgctgggcaacaccgaccggcactccatcaagaagaacctgatcggcgccctgctgttcgactccggcgagaccgccgaggccacccggctgaagcggaccgcccggcggcggtacacccggcggaagaaccggatctgctacctgcaggagatcttctccaacgagatggccaaggtggacgactccttcttccaccggctggaggagtccttcctggtggaggaggacaagaagcacgagcggcaccccatcttcggcaacatcgtggacgaggtggcctaccacgagaagtaccccaccatctaccacctgcggaagaagctggtggactccaccgacaaggccgacctgcggctgatctacctggccctggcccacatgatcaagttccggggccacttcctgatcgagggcgacctgaaccccgacaactccgacgtggacaagctgttcatccagctggtgcagacctacaaccagctgttcgaggagaaccccatcaacgcctccggcgtggacgccaaggccatcctgtccgcccggctgtccaagtcccggcggctggagaacctgatcgcccagctgcccggcgagaagaagaacggcctgttcggcaacctgatcgccctgtccctgggcctgacccccaacttcaagtccaacttcgacctggccgaggacgccaagctgcagctgtccaaggacacctacgacgacgacctggacaacctgctggcccagatcggcgaccagtacgccgacctgttcctggccgccaagaacctgtccgacgccatcctgctgtccgacatcctgcgggtgaacaccgagatcaccaaggcccccctgtccgcctccatgatcaagcggtacgacgagcaccaccaggacctgaccctgctgaaggccctggtgcggcagcagctgcccgagaagtacaaggagatcttcttcgaccagtccaagaacggctacgccggctacatcgacggcggcgcctcccaggaggagttctacaagttcatcaagcccatcctggagaagatggacggcaccgaggagctgctggtgaagctgaaccgggaggacctgctgcggaagcagcggaccttcgacaacggctccatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaactcccggttcgcctggatgacccggaagtccgaggagaccatcaccccctggaacttcgaggaggtggtggacaagggcgcctccgcccagtccttcatcgagcggatgaccaacttcgacaagaacctgcccaacgagaaggtgctgcccaagcactccctgctgtacgagtacttcaccgtgtacaacgagctgaccaaggtgaagtacgtgaccgagggcatgcggaagcccgccttcctgtccggcgagcagaagaaggccatcgtggacctgctgttcaagaccaaccggaaggtgaccgtgaagcagctgaaggaggactacttcaagaagatcgagtgcttcgactccgtggagatctccggcgtggaggaccggttcaacgcctccctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgtcccggaagctgatcaacggcatccgggacaagcagtccggcaagaccatcctggacttcctgaagtccgacggcttcgccaaccggaacttcatgcagctgatccacgacgactccctgaccttcaaggaggacatccagaaggcccaggtgtccggccagggcgactccctgcacgagcacatcgccaacctggccggctcccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaactcccgggagcggatgaagcggatcgaggagggcatcaaggagctgggctcccagatcctgaaggagcaccccgtggagaacacccagctgcagaacgagaagctgtacctgtactacctgcagaacggccgggacatgtacgtggaccaggagctggacatcaaccggctgtccgactacgacgtggaccacatcgtgccccagtccttcctgaaggacgactccatcgacaacaaggtgctgacccggtccgacaagaaccggggcaagtccgacaacgtgccctccgaggaggtggtgaagaagatgaagaactactggcggcagctgctgaacgccaagctgatcacccagcggaagttcgacaacctgaccaaggccgagcggggcggcctgtccgagctggacaaggccggcttcatcaagcggcagctggtggagacccggcagatcaccaagcacgtggcccagatcctggactcccggatgaacaccaagtacgacgagaacgacaagctgatccgggaggtgaaggtgatcaccctgaagtccaagctggtgtccgacttccggaaggacttccagttctacaaggtgcgggagatcaacaactaccaccacgcccacgacgcctacctgaacgccgtggtgggcaccgccctgatcaagaagtaccccaagctggagtccgagttcgtgtacggcgactacaaggtgtacgacgtgcggaagatgatcgccaagtccgagcaggagatcggcaaggccaccgccaagtacttcttctactccaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgtccatgccccaggtgaacatcgtgaagaagaccgaggtgcagaccggcggcttctccaaggagtccatcctgcccaagcggaactccgacaagctgatcgcccggaagaaggactgggaccccaagaagtacggcggcttcgactcccccaccgtggcctactccgtgctggtggtggccaaggtggagaagggcaagtccaagaagctgaagtccgtgaaggagctgctgggcatcaccatcatggagcggtcctccttcgagaagaaccccatcgacttcctggaggccaagggctacaaggaggtgaagaaggacctgatcatcaagctgcccaagtactccctgttcgagctggagaacggccggaagcggatgctggcctccgccggcgagctgcagaagggcaacgagctggccctgccctccaagtacgtgaacttcctgtacctggcctcccactacgagaagctgaagggctcccccgaggacaacgagcagaagcagctgttcgtggagcagcacaagcactacctggacgagatcatcgagcagatctccgagttctccaagcgggtgatcctggccgacgccaacctggacaaggtgctgtccgcctacaacaagcaccgggacaagcccatccgggagcaggccgagaacatcatccacctgttcaccctgaccaacctgggcgcccccgccgccttcaagtacttcgacaccaccatcgaccggaagcggtacacctccaccaaggaggtgctggacgccaccctgatccaccagtccatcaccggcctgtacgagacccggatcgacctgtcccagctgggcggcgacggcggcggctcccccaagaagaagcggaaggtgtga

SEQ ID NO: 115 - DNA, 4107 bp, Artificial Sequence
  Synthetic: Cas9 nickase ORF using low A codons of Table 4, with start and stop codons and no NLS
atggacaagaagtactccatcggcctggccatcggcaccaactccgtgggctgggccgtgatcaccgacgagtacaaggtgccctccaagaagttcaaggtgctgggcaacaccgaccggcactccatcaagaagaacctgatcggcgccctgctgttcgactccggcgagaccgccgaggccacccggctgaagcggaccgcccggcggcggtacacccggcggaagaaccggatctgctacctgcaggagatcttctccaacgagatggccaaggtggacgactccttcttccaccggctggaggagtccttcctggtggaggaggacaagaagcacgagcggcaccccatcttcggcaacatcgtggacgaggtggcctaccacgagaagtaccccaccatctaccacctgcggaagaagctggtggactccaccgacaaggccgacctgcggctgatctacctggccctggcccacatgatcaagttccggggccacttcctgatcgagggcgacctgaaccccgacaactccgacgtggacaagctgttcatccagctggtgcagacctacaaccagctgttcgaggagaaccccatcaacgcctccggcgtggacgccaaggccatcctgtccgcccggctgtccaagtcccggcggctggagaacctgatcgcccagctgcccggcgagaagaagaacggcctgttcggcaacctgatcgccctgtccctgggcctgacccccaacttcaagtccaacttcgacctggccgaggacgccaagctgcagctgtccaaggacacctacgacgacgacctggacaacctgctggcccagatcggcgaccagtacgccgacctgttcctggccgccaagaacctgtccgacgccatcctgctgtccgacatcctgcgggtgaacaccgagatcaccaaggcccccctgtccgcctccatgatcaagcggtacgacgagcaccaccaggacctgaccctgctgaaggccctggtgcggcagcagctgcccgagaagtacaaggagatcttcttcgaccagtccaagaacggctacgccggctacatcgacggcggcgcctcccaggaggagttctacaagttcatcaagcccatcctggagaagatggacggcaccgaggagctgctggtgaagctgaaccgggaggacctgctgcggaagcagcggaccttcgacaacggctccatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaactcccggttcgcctggatgacccggaagtccgaggagaccatcaccccctggaacttcgaggaggtggtggacaagggcgcctccgcccagtccttcatcgagcggatgaccaacttcgacaagaacctgcccaacgagaaggtgctgcccaagcactccctgctgtacgagtacttcaccgtgtacaacgagctgaccaaggtgaagtacgtgaccgagggcatgcggaagcccgccttcctgtccggcgagcagaagaaggccatcgtggacctgctgttcaagaccaaccggaaggtgaccgtgaagcagctgaaggaggactacttcaagaagatcgagtgcttcgactccgtggagatctccggcgtggaggaccggttcaacgcctccctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgtcccggaagctgatcaacggcatccgggacaagcagtccggcaagaccatcctggacttcctgaagtccgacggcttcgccaaccggaacttcatgcagctgatccacgacgactccctgaccttcaaggaggacatccagaaggcccaggtgtccggccagggcgactccctgcacgagcacatcgccaacctggccggctcccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaactcccgggagcggatgaagcggatcgaggagggcatcaaggagctgggctcccagatcctgaaggagcaccccgtggagaacacccagctgcagaacgagaagctgtacctgtactacctgcagaacggccgggacatgtacgtggaccaggagctggacatcaaccggctgtccgactacgacgtggaccacatcgtgccccagtccttcctgaaggacgactccatcgacaacaaggtgctgacccggtccgacaagaaccggggcaagtccgacaacgtgccctccgaggaggtggtgaagaagatgaagaactactggcggcagctgctgaacgccaagctgatcacccagcggaagttcgacaacctgaccaaggccgagcggggcggcctgtccgagctggacaaggccggcttcatcaagcggcagctggtggagacccggcagatcaccaagcacgtggcccagatcctggactcccggatgaacaccaagtacgacgagaacgacaagctgatccgggaggtgaaggtgatcaccctgaagtccaagctggtgtccgacttccggaaggacttccagttctacaaggtgcgggagatcaacaactaccaccacgcccacgacgcctacctgaacgccgtggtgggcaccgccctgatcaagaagtaccccaagctggagtccgagttcgtgtacggcgactacaaggtgtacgacgtgcggaagatgatcgccaagtccgagcaggagatcggcaaggccaccgccaagtacttcttctactccaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgtccatgccccaggtgaacatcgtgaagaagaccgaggtgcagaccggcggcttctccaaggagtccatcctgcccaagcggaactccgacaagctgatcgcccggaagaaggactgggaccccaagaagtacggcggcttcgactcccccaccgtggcctactccgtgctggtggtggccaaggtggagaagggcaagtccaagaagctgaagtccgtgaaggagctgctgggcatcaccatcatggagcggtcctccttcgagaagaaccccatcgacttcctggaggccaagggctacaaggaggtgaagaaggacctgatcatcaagctgcccaagtactccctgttcgagctggagaacggccggaagcggatgctggcctccgccggcgagctgcagaagggcaacgagctggccctgccctccaagtacgtgaacttcctgtacctggcctcccactacgagaagctgaagggctcccccgaggacaacgagcagaagcagctgttcgtggagcagcacaagcactacctggacgagatcatcgagcagatctccgagttctccaagcgggtgatcctggccgacgccaacctggacaaggtgctgtccgcctacaacaagcaccgggacaagcccatccgggagcaggccgagaacatcatccacctgttcaccctgaccaacctgggcgcccccgccgccttcaagtacttcgacaccaccatcgaccggaagcggtacacctccaccaaggaggtgctggacgccaccctgatccaccagtccatcaccggcctgtacgagacccggatcgacctgtcccagctgggcggcgactga

SEQ ID NO: 116 - DNA, 4179 bp, Artificial Sequence
  Synthetic: Cas9 nickase ORF using low A codons of Table 4, with two C-terminal NLS sequences and start and stop codons
atggacaagaagtactccatcggcctggccatcggcaccaactccgtgggctgggccgtgatcaccgacgagtacaaggtgccctccaagaagttcaaggtgctgggcaacaccgaccggcactccatcaagaagaacctgatcggcgccctgctgttcgactccggcgagaccgccgaggccacccggctgaagcggaccgcccggcggcggtacacccggcggaagaaccggatctgctacctgcaggagatcttctccaacgagatggccaaggtggacgactccttcttccaccggctggaggagtccttcctggtggaggaggacaagaagcacgagcggcaccccatcttcggcaacatcgtggacgaggtggcctaccacgagaagtaccccaccatctaccacctgcggaagaagctggtggactccaccgacaaggccgacctgcggctgatctacctggccctggcccacatgatcaagttccggggccacttcctgatcgagggcgacctgaaccccgacaactccgacgtggacaagctgttcatccagctggtgcagacctacaaccagctgttcgaggagaaccccatcaacgcctccggcgtggacgccaaggccatcctgtccgcccggctgtccaagtcccggcggctggagaacctgatcgcccagctgcccggcgagaagaagaacggcctgttcggcaacctgatcgccctgtccctgggcctgacccccaacttcaagtccaacttcgacctggccgaggacgccaagctgcagctgtccaaggacacctacgacgacgacctggacaacctgctggcccagatcggcgaccagtacgccgacctgttcctggccgccaagaacctgtccgacgccatcctgctgtccgacatcctgcgggtgaacaccgagatcaccaaggcccccctgtccgcctccatgatcaagcggtacgacgagcaccaccaggacctgaccctgctgaaggccctggtgcggcagcagctgcccgagaagtacaaggagatcttcttcgaccagtccaagaacggctacgccggctacatcgacggcggcgcctcccaggaggagttctacaagttcatcaagcccatcctggagaagatggacggcaccgaggagctgctggtgaagctgaaccgggaggacctgctgcggaagcagcggaccttcgacaacggctccatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaactcccggttcgcctggatgacccggaagtccgaggagaccatcaccccctggaacttcgaggaggtggtggacaagggcgcctccgcccagtccttcatcgagcggatgaccaacttcgacaagaacctgcccaacgagaaggtgctgcccaagcactccctgctgtacgagtacttcaccgtgtacaacgagctgaccaaggtgaagtacgtgaccgagggcatgcggaagcccgccttcctgtccggcgagcagaagaaggccatcgtggacctgctgttcaagaccaaccggaaggtgaccgtgaagcagctgaaggaggactacttcaagaagatcgagtgcttcgactccgtggagatctccggcgtggaggaccggttcaacgcctccctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgtcccggaagctgatcaacggcatccgggacaagcagtccggcaagaccatcctggacttcctgaagtccgacggcttcgccaaccggaacttcatgcagctgatccacgacgactccctgaccttcaaggaggacatccagaaggcccaggtgtccggccagggcgactccctgcacgagcacatcgccaacctggccggctcccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaactcccgggagcggatgaagcggatcgaggagggcatcaaggagctgggctcccagatcctgaaggagcaccccgtggagaacacccagctgcagaacgagaagctgtacctgtactacctgcagaacggccgggacatgtacgtggaccaggagctggacatcaaccggctgtccgactacgacgtggaccacatcgtgccccagtccttcctgaaggacgactccatcgacaacaaggtgctgacccggtccgacaagaaccggggcaagtccgacaacgtgccctccgaggaggtggtgaagaagatgaagaactactggcggcagctgctgaacgccaagctgatcacccagcggaagttcgacaacctgaccaaggccgagcggggcggcctgtccgagctggacaaggccggcttcatcaagcggcagctggtggagacccggcagatcaccaagcacgtggcccagatcctggactcccggatgaacaccaagtacgacgagaacgacaagctgatccgggaggtgaaggtgatcaccctgaagtccaagctggtgtccgacttccggaaggacttccagttctacaaggtgcgggagatcaacaactaccaccacgcccacgacgcctacctgaacgccgtggtgggcaccgccctgatcaagaagtaccccaagctggagtccgagttcgtgtacggcgactacaaggtgtacgacgtgcggaagatgatcgccaagtccgagcaggagatcggcaaggccaccgccaagtacttcttctactccaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgtccatgccccaggtgaacatcgtgaagaagaccgaggtgcagaccggcggcttctccaaggagtccatcctgcccaagcggaactccgacaagctgatcgcccggaagaaggactgggaccccaagaagtacggcggcttcgactcccccaccgtggcctactccgtgctggtggtggccaaggtggagaagggcaagtccaagaagctgaagtccgtgaaggagctgctgggcatcaccatcatggagcggtcctccttcgagaagaaccccatcgacttcctggaggccaagggctacaaggaggtgaagaaggacctgatcatcaagctgcccaagtactccctgttcgagctggagaacggccggaagcggatgctggcctccgccggcgagctgcagaagggcaacgagctggccctgccctccaagtacgtgaacttcctgtacctggcctcccactacgagaagctgaagggctcccccgaggacaacgagcagaagcagctgttcgtggagcagcacaagcactacctggacgagatcatcgagcagatctccgagttctccaagcgggtgatcctggccgacgccaacctggacaaggtgctgtccgcctacaacaagcaccgggacaagcccatccgggagcaggccgagaacatcatccacctgttcaccctgaccaacctgggcgcccccgccgccttcaagtacttcgacaccaccatcgaccggaagcggtacacctccaccaaggaggtgctggacgccaccctgatccaccagtccatcaccggcctgtacgagacccggatcgacctgtcccagctgggcggcgacggctccggctcccccaagaagaagcggaaggtggacggctcccccaagaagaagcggaaggtggactccggctga

SEQ ID NO: 117 - DNA, 4140 bp, Artificial Sequence
  Synthetic: dCas9 ORF using low A codons of Table 4, with start and stop codons
atggacaagaagtactccatcggcctggccatcggcaccaactccgtgggctgggccgtgatcaccgacgagtacaaggtgccctccaagaagttcaaggtgctgggcaacaccgaccggcactccatcaagaagaacctgatcggcgccctgctgttcgactccggcgagaccgccgaggccacccggctgaagcggaccgcccggcggcggtacacccggcggaagaaccggatctgctacctgcaggagatcttctccaacgagatggccaaggtggacgactccttcttccaccggctggaggagtccttcctggtggaggaggacaagaagcacgagcggcaccccatcttcggcaacatcgtggacgaggtggcctaccacgagaagtaccccaccatctaccacctgcggaagaagctggtggactccaccgacaaggccgacctgcggctgatctacctggccctggcccacatgatcaagttccggggccacttcctgatcgagggcgacctgaaccccgacaactccgacgtggacaagctgttcatccagctggtgcagacctacaaccagctgttcgaggagaaccccatcaacgcctccggcgtggacgccaaggccatcctgtccgcccggctgtccaagtcccggcggctggagaacctgatcgcccagctgcccggcgagaagaagaacggcctgttcggcaacctgatcgccctgtccctgggcctgacccccaacttcaagtccaacttcgacctggccgaggacgccaagctgcagctgtccaaggacacctacgacgacgacctggacaacctgctggcccagatcggcgaccagtacgccgacctgttcctggccgccaagaacctgtccgacgccatcctgctgtccgacatcctgcgggtgaacaccgagatcaccaaggcccccctgtccgcctccatgatcaagcggtacgacgagcaccaccaggacctgaccctgctgaaggccctggtgcggcagcagctgcccgagaagtacaaggagatcttcttcgaccagtccaagaacggctacgccggctacatcgacggcggcgcctcccaggaggagttctacaagttcatcaagcccatcctggagaagatggacggcaccgaggagctgctggtgaagctgaaccgggaggacctgctgcggaagcagcggaccttcgacaacggctccatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaactcccggttcgcctggatgacccggaagtccgaggagaccatcaccccctggaacttcgaggaggtggtggacaagggcgcctccgcccagtccttcatcgagcggatgaccaacttcgacaagaacctgcccaacgagaaggtgctgcccaagcactccctgctgtacgagtacttcaccgtgtacaacgagctgaccaaggtgaagtacgtgaccgagggcatgcggaagcccgccttcctgtccggcgagcagaagaaggccatcgtggacctgctgttcaagaccaaccggaaggtgaccgtgaagcagctgaaggaggactacttcaagaagatcgagtgcttcgactccgtggagatctccggcgtggaggaccggttcaacgcctccctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgtcccggaagctgatcaacggcatccgggacaagcagtccggcaagaccatcctggacttcctgaagtccgacggcttcgccaaccggaacttcatgcagctgatccacgacgactccctgaccttcaaggaggacatccagaaggcccaggtgtccggccagggcgactccctgcacgagcacatcgccaacctggccggctcccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaactcccgggagcggatgaagcggatcgaggagggcatcaaggagctgggctcccagatcctgaaggagcaccccgtggagaacacccagctgcagaacgagaagctgtacctgtactacctgcagaacggccgggacatgtacgtggaccaggagctggacatcaaccggctgtccgactacgacgtggacgccatcgtgccccagtccttcctgaaggacgactccatcgacaacaaggtgctgacccggtccgacaagaaccggggcaagtccgacaacgtgccctccgaggaggtggtgaagaagatgaagaactactggcggcagctgctgaacgccaagctgatcacccagcggaagttcgacaacctgaccaaggccgagcggggcggcctgtccgagctggacaaggccggcttcatcaagcggcagctggtggagacccggcagatcaccaagcacgtggcccagatcctggactcccggatgaacaccaagtacgacgagaacgacaagctgatccgggaggtgaaggtgatcaccctgaagtccaagctggtgtccgacttccggaaggacttccagttctacaaggtgcgggagatcaacaactaccaccacgcccacgacgcctacctgaacgccgtggtgggcaccgccctgatcaagaagtaccccaagctggagtccgagttcgtgtacggcgactacaaggtgtacgacgtgcggaagatgatcgccaagtccgagcaggagatcggcaaggccaccgccaagtacttcttctactccaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgtccatgccccaggtgaacatcgtgaagaagaccgaggtgcagaccggcggcttctccaaggagtccatcctgcccaagcggaactccgacaagctgatcgcccggaagaaggactgggaccccaagaagtacggcggcttcgactcccccaccgtggcctactccgtgctggtggtggccaaggtggagaagggcaagtccaagaagctgaagtccgtgaaggagctgctgggcatcaccatcatggagcggtcctccttcgagaagaaccccatcgacttcctggaggccaagggctacaaggaggtgaagaaggacctgatcatcaagctgcccaagtactccctgttcgagctggagaacggccggaagcggatgctggcctccgccggcgagctgcagaagggcaacgagctggccctgccctccaagtacgtgaacttcctgtacctggcctcccactacgagaagctgaagggctcccccgaggacaacgagcagaagcagctgttcgtggagcagcacaagcactacctggacgagatcatcgagcagatctccgagttctccaagcgggtgatcctggccgacgccaacctggacaaggtgctgtccgcctacaacaagcaccgggacaagcccatccgggagcaggccgagaacatcatccacctgttcaccctgaccaacctgggcgcccccgccgccttcaagtacttcgacaccaccatcgaccggaagcggtacacctccaccaaggaggtgctggacgccaccctgatccaccagtccatcaccggcctgtacgagacccggatcgacctgtcccagctgggcggcgacggcggcggctcccccaagaagaagcggaaggtgtga

SEQ ID NO: 118 - DNA, 4107 bp, Artificial Sequence
  Synthetic: dCas9 ORF using low A codons of Table 4, with start and stop codons and no NLS
atggacaagaagtactccatcggcctggccatcggcaccaactccgtgggctgggccgtgatcaccgacgagtacaaggtgccctccaagaagttcaaggtgctgggcaacaccgaccggcactccatcaagaagaacctgatcggcgccctgctgttcgactccggcgagaccgccgaggccacccggctgaagcggaccgcccggcggcggtacacccggcggaagaaccggatctgctacctgcaggagatcttctccaacgagatggccaaggtggacgactccttcttccaccggctggaggagtccttcctggtggaggaggacaagaagcacgagcggcaccccatcttcggcaacatcgtggacgaggtggcctaccacgagaagtaccccaccatctaccacctgcggaagaagctggtggactccaccgacaaggccgacctgcggctgatctacctggccctggcccacatgatcaagttccggggccacttcctgatcgagggcgacctgaaccccgacaactccgacgtggacaagctgttcatccagctggtgcagacctacaaccagctgttcgaggagaaccccatcaacgcctccggcgtggacgccaaggccatcctgtccgcccggctgtccaagtcccggcggctggagaacctgatcgcccagctgcccggcgagaagaagaacggcctgttcggcaacctgatcgccctgtccctgggcctgacccccaacttcaagtccaacttcgacctggccgaggacgccaagctgcagctgtccaaggacacctacgacgacgacctggacaacctgctggcccagatcggcgaccagtacgccgacctgttcctggccgccaagaacctgtccgacgccatcctgctgtccgacatcctgcgggtgaacaccgagatcaccaaggcccccctgtccgcctccatgatcaagcggtacgacgagcaccaccaggacctgaccctgctgaaggccctggtgcggcagcagctgcccgagaagtacaaggagatcttcttcgaccagtccaagaacggctacgccggctacatcgacggcggcgcctcccaggaggagttctacaagttcatcaagcccatcctggagaagatggacggcaccgaggagctgctggtgaagctgaaccgggaggacctgctgcggaagcagcggaccttcgacaacggctccatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaactcccggttcgcctggatgacccggaagtccgaggagaccatcaccccctggaacttcgaggaggtggtggacaagggcgcctccgcccagtccttcatcgagcggatgaccaacttcgacaagaacctgcccaacgagaaggtgctgcccaagcactccctgctgtacgagtacttcaccgtgtacaacgagctgaccaaggtgaagtacgtgaccgagggcatgcggaagcccgccttcctgtccggcgagcagaagaaggccatcgtggacctgctgttcaagaccaaccggaaggtgaccgtgaagcagctgaaggaggactacttcaagaagatcgagtgcttcgactccgtggagatctccggcgtggaggaccggttcaacgcctccctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgtcccggaagctgatcaacggcatccgggacaagcagtccggcaagaccatcctggacttcctgaagtccgacggcttcgccaaccggaacttcatgcagctgatccacgacgactccctgaccttcaaggaggacatccagaaggcccaggtgtccggccagggcgactccctgcacgagcacatcgccaacctggccggctcccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaactcccgggagcggatgaagcggatcgaggagggcatcaaggagctgggctcccagatcctgaaggagcaccccgtggagaacacccagctgcagaacgagaagctgtacctgtactacctgcagaacggccgggacatgtacgtggaccaggagctggacatcaaccggctgtccgactacgacgtggacgccatcgtgccccagtccttcctgaaggacgactccatcgacaacaaggtgctgacccggtccgacaagaaccggggcaagtccgacaacgtgccctccgaggaggtggtgaagaagatgaagaactactggcggcagctgctgaacgccaagctgatcacccagcggaagttcgacaacctgaccaaggccgagcggggcggcctgtccgagctggacaaggccggcttcatcaagcggcagctggtggagacccggcagatcaccaagcacgtggcccagatcctggactcccggatgaacaccaagtacgacgagaacgacaagctgatccgggaggtgaaggtgatcaccctgaagtccaagctggtgtccgacttccggaaggacttccagttctacaaggtgcgggagatcaacaactaccaccacgcccacgacgcctacctgaacgccgtggtgggcaccgccctgatcaagaagtaccccaagctggagtccgagttcgtgtacggcgactacaaggtgtacgacgtgcggaagatgatcgccaagtccgagcaggagatcggcaaggccaccgccaagtacttcttctactccaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgtccatgccccaggtgaacatcgtgaagaagaccgaggtgcagaccggcggcttctccaaggagtccatcctgcccaagcggaactccgacaagctgatcgcccggaagaaggactgggaccccaagaagtacggcggcttcgactcccccaccgtggcctactccgtgctggtggtggccaaggtggagaagggcaagtccaagaagctgaagtccgtgaaggagctgctgggcatcaccatcatggagcggtcctccttcgagaagaaccccatcgacttcctggaggccaagggctacaaggaggtgaagaaggacctgatcatcaagctgcccaagtactccctgttcgagctggagaacggccggaagcggatgctggcctccgccggcgagctgcagaagggcaacgagctggccctgccctccaagtacgtgaacttcctgtacctggcctcccactacgagaagctgaagggctcccccgaggacaacgagcagaagcagctgttcgtggagcagcacaagcactacctggacgagatcatcgagcagatctccgagttctccaagcgggtgatcctggccgacgccaacctggacaaggtgctgtccgcctacaacaagcaccgggacaagcccatccgggagcaggccgagaacatcatccacctgttcaccctgaccaacctgggcgcccccgccgccttcaagtacttcgacaccaccatcgaccggaagcggtacacctccaccaaggaggtgctggacgccaccctgatccaccagtccatcaccggcctgtacgagacccggatcgacctgtcccagctgggcggcgactga

SEQ ID NO: 119 - DNA, 4179 bp, Artificial Sequence
  Synthetic: dCas9 ORF using low A codons of Table 4, with two C-terminal NLS sequences and start and stop codons
atggacaagaagtactccatcggcctggccatcggcaccaactccgtgggctgggccgtgatcaccgacgagtacaaggtgccctccaagaagttcaaggtgctgggcaacaccgaccggcactccatcaagaagaacctgatcggcgccctgctgttcgactccggcgagaccgccgaggccacccggctgaagcggaccgcccggcggcggtacacccggcggaagaaccggatctgctacctgcaggagatcttctccaacgagatggccaaggtggacgactccttcttccaccggctggaggagtccttcctggtggaggaggacaagaagcacgagcggcaccccatcttcggcaacatcgtggacgaggtggcctaccacgagaagtaccccaccatctaccacctgcggaagaagctggtggactccaccgacaaggccgacctgcggctgatctacctggccctggcccacatgatcaagttccggggccacttcctgatcgagggcgacctgaaccccgacaactccgacgtggacaagctgttcatccagctggtgcagacctacaaccagctgttcgaggagaaccccatcaacgcctccggcgtggacgccaaggccatcctgtccgcccggctgtccaagtcccggcggctggagaacctgatcgcccagctgcccggcgagaagaagaacggcctgttcggcaacctgatcgccctgtccctgggcctgacccccaacttcaagtccaacttcgacctggccgaggacgccaagctgcagctgtccaaggacacctacgacgacgacctggacaacctgctggcccagatcggcgaccagtacgccgacctgttcctggccgccaagaacctgtccgacgccatcctgctgtccgacatcctgcgggtgaacaccgagatcaccaaggcccccctgtccgcctccatgatcaagcggtacgacgagcaccaccaggacctgaccctgctgaaggccctggtgcggcagcagctgcccgagaagtacaaggagatcttcttcgaccagtccaagaacggctacgccggctacatcgacggcggcgcctcccaggaggagttctacaagttcatcaagcccatcctggagaagatggacggcaccgaggagctgctggtgaagctgaaccgggaggacctgctgcggaagcagcggaccttcgacaacggctccatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaactcccggttcgcctggatgacccggaagtccgaggagaccatcaccccctggaacttcgaggaggtggtggacaagggcgcctccgcccagtccttcatcgagcggatgaccaacttcgacaagaacctgcccaacgagaaggtgctgcccaagcactccctgctgtacgagtacttcaccgtgtacaacgagctgaccaaggtgaagtacgtgaccgagggcatgcggaagcccgccttcctgtccggcgagcagaagaaggccatcgtggacctgctgttcaagaccaaccggaaggtgaccgtgaagcagctgaaggaggactacttcaagaagatcgagtgcttcgactccgtggagatctccggcgtggaggaccggttcaacgcctccctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgtcccggaagctgatcaacggcatccgggacaagcagtccggcaagaccatcctggacttcctgaagtccgacggcttcgccaaccggaacttcatgcagctgatccacgacgactccctgaccttcaaggaggacatccagaaggcccaggtgtccggccagggcgactccctgcacgagcacatcgccaacctggccggctcccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaactcccgggagcggatgaagcggatcgaggagggcatcaaggagctgggctcccagatcctgaaggagcaccccgtggagaacacccagctgcagaacgagaagctgtacctgtactacctgcagaacggccgggacatgtacgtggaccaggagctggacatcaaccggctgtccgactacgacgtggacgccatcgtgccccagtccttcctgaaggacgactccatcgacaacaaggtgctgacccggtccgacaagaaccggggcaagtccgacaacgtgccctccgaggaggtggtgaagaagatgaagaactactggcggcagctgctgaacgccaagctgatcacccagcggaagttcgacaacctgaccaaggccgagcggggcggcctgtccgagctggacaaggccggcttcatcaagcggcagctggtggagacccggcagatcaccaagcacgtggcccagatcctggactcccggatgaacaccaagtacgacgagaacgacaagctgatccgggaggtgaaggtgatcaccctgaagtccaagctggtgtccgacttccggaaggacttccagttctacaaggtgcgggagatcaacaactaccaccacgcccacgacgcctacctgaacgccgtggtgggcaccgccctgatcaagaagtaccccaagctggagtccgagttcgtgtacggcgactacaaggtgtacgacgtgcggaagatgatcgccaagtccgagcaggagatcggcaaggccaccgccaagtacttcttctactccaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgtccatgccccaggtgaacatcgtgaagaagaccgaggtgcagaccggcggcttctccaaggagtccatcctgcccaagcggaactccgacaagctgatcgcccggaagaaggactgggaccccaagaagtacggcggcttcgactcccccaccgtggcctactccgtgctggtggtggccaaggtggagaagggcaagtccaagaagctgaagtccgtgaaggagctgctgggcatcaccatcatggagcggtcctccttcgagaagaaccccatcgacttcctggaggccaagggctacaaggaggtgaagaaggacctgatcatcaagctgcccaagtactccctgttcgagctggagaacggccggaagcggatgctggcctccgccggcgagctgcagaagggcaacgagctggccctgccctccaagtacgtgaacttcctgtacctggcctcccactacgagaagctgaagggctcccccgaggacaacgagcagaagcagctgttcgtggagcagcacaagcactacctggacgagatcatcgagcagatctccgagttctccaagcgggtgatcctggccgacgccaacctggacaaggtgctgtccgcctacaacaagcaccgggacaagcccatccgggagcaggccgagaacatcatccacctgttcaccctgaccaacctgggcgcccccgccgccttcaagtacttcgacaccaccatcgaccggaagcggtacacctccaccaaggaggtgctggacgccaccctgatccaccagtccatcaccggcctgtacgagacccggatcgacctgtcccagctgggcggcgacggctccggctcccccaagaagaagcggaaggtggacggctcccccaagaagaagcggaaggtggactccggctga

SEQ ID NO: 120 - DNA, 4179 bp, Artificial Sequence
  Synthetic: Cas9 ORF using low A/U codons of Table 4, with two C-terminal NLS sequences and start and stop codons
atggacaagaagtacagcatcggcctggacatcggcaccaacagcgtgggctgggccgtgatcaccgacgagtacaaggtgcccagcaagaagttcaaggtgctgggcaacaccgaccggcacagcatcaagaagaacctgatcggcgccctgctgttcgacagcggcgagaccgccgaggccacccggctgaagcggaccgcccggcggcggtacacccggcggaagaaccggatctgctacctgcaggagatcttcagcaacgagatggccaaggtggacgacagcttcttccaccggctggaggagagcttcctggtggaggaggacaagaagcacgagcggcaccccatcttcggcaacatcgtggacgaggtggcctaccacgagaagtaccccaccatctaccacctgcggaagaagctggtggacagcaccgacaaggccgacctgcggctgatctacctggccctggcccacatgatcaagttccggggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccggctgagcaagagccggcggctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgggtgaacaccgagatcaccaaggcccccctgagcgccagcatgatcaagcggtacgacgagcaccaccaggacctgaccctgctgaaggccctggtgcggcagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgggaggacctgctgcggaagcagcggaccttcgacaacggcagcatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaacagccggttcgcctggatgacccggaagagcgaggagaccatcaccccctggaacttcgaggaggtggtggacaagggcgccagcgcccagagcttcatcgagcggatgaccaacttcgacaagaacctgcccaacgagaaggtgctgcccaagcacagcctgctgtacgagtacttcaccgtgtacaacgagctgaccaaggtgaagtacgtgaccgagggcatgcggaagcccgccttcctgagcggcgagcagaagaaggccatcgtggacctgctgttcaagaccaaccggaaggtgaccgtgaagcagctgaaggaggactacttcaagaagatcgagtgcttcgacagcgtggagatcagcggcgtggaggaccggttcaacgccagcctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgagccggaagctgatcaacggcatccgggacaagcagagcggcaagaccatcctggacttcctgaagagcgacggcttcgccaaccggaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaacagccgggagcggatgaagcggatcgaggagggcatcaaggagctgggcagccagatcctgaaggagcaccccgtggagaacacccagctgcagaacgagaagctgtacctgtactacctgcagaacggccgggacatgtacgtggaccaggagctggacatcaaccggctgagcgactacgacgtggaccacatcgtgccccagagcttcctgaaggacgacagcatcgacaacaaggtgctgacccggagcgacaagaaccggggcaagagcgacaacgtgcccagcgaggaggtggtgaagaagatgaagaactactggcggcagctgctgaacgccaagctgatcacccagcggaagttcgacaacctgaccaaggccgagcggggcggcctgagcgagctggacaaggccggcttcatcaagcggcagctggtggagacccggcagatcaccaagcacgtggcccagatcctggacagccggatgaacaccaagtacgacgagaacgacaagctgatccgggaggtgaaggtgatcaccctgaagagcaagctggtgagcgacttccggaaggacttccagttctacaaggtgcgggagatcaacaactaccaccacgcccacgacgcctacctgaacgccgtggtgggcaccgccctgatcaagaagtaccccaagctggagagcgagttcgtgtacggcgactacaaggtgtacgacgtgcggaagatgatcgccaagagcgagcaggagatcggcaaggccaccgccaagtacttcttctacagcaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgagcatgccccaggtgaacatcgtgaagaagaccgaggtgcagaccggcggcttcagcaaggagagcatcctgcccaagcggaacagcgacaagctgatcgcccggaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcggagcagcttcgagaagaaccccatcgacttcctggaggccaagggctacaaggaggtgaagaaggacctgatcatcaagctgcccaagtacagcctgttcgagctggagaacggccggaagcggatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgggtgatcctggccgacgccaacctggacaaggtgctgagcgcctacaacaagcaccgggacaagcccatccgggagcaggccgagaacatcatccacctgttcaccctgaccaacctgggcgcccccgccgccttcaagtacttcgacaccaccatcgaccggaagcggtacaccagcaccaaggaggtgctggacgccaccctgatccaccagagcatcaccggcctgtacgagacccggatcgacctgagccagctgggcggcgacggcagcggcagccccaagaagaagcggaaggtggacggcagccccaagaagaagcggaaggtggacagcggctga

SEQ ID NO: 121 - DNA, 4107 bp, Artificial Sequence
  Synthetic: Cas9 ORF using low A/U codons of Table 4, with start and stop codons and no NLS
atggacaagaagtacagcatcggcctggacatcggcaccaacagcgtgggctgggccgtgatcaccgacgagtacaaggtgcccagcaagaagttcaaggtgctgggcaacaccgaccggcacagcatcaagaagaacctgatcggcgccctgctgttcgacagcggcgagaccgccgaggccacccggctgaagcggaccgcccggcggcggtacacccggcggaagaaccggatctgctacctgcaggagatcttcagcaacgagatggccaaggtggacgacagcttcttccaccggctggaggagagcttcctggtggaggaggacaagaagcacgagcggcaccccatcttcggcaacatcgtggacgaggtggcctaccacgagaagtaccccaccatctaccacctgcggaagaagctggtggacagcaccgacaaggccgacctgcggctgatctacctggccctggcccacatgatcaagttccggggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccggctgagcaagagccggcggctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgggtgaacaccgagatcaccaaggcccccctgagcgccagcatgatcaagcggtacgacgagcaccaccaggacctgaccctgctgaaggccctggtgcggcagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgggaggacctgctgcggaagcagcggaccttcgacaacggcagcatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaacagccggttcgcctggatgacccggaagagcgaggagaccatcaccccctggaacttcgaggaggtggtggacaagggcgccagcgcccagagcttcatcgagcggatgaccaacttcgacaagaacctgcccaacgagaaggtgctgcccaagcacagcctgctgtacgagtacttcaccgtgtacaacgagctgaccaaggtgaagtacgtgaccgagggcatgcggaagcccgccttcctgagcggcgagcagaagaaggccatcgtggacctgctgttcaagaccaaccggaaggtgaccgtgaagcagctgaaggaggactacttcaagaagatcgagtgcttcgacagcgtggagatcagcggcgtggaggaccggttcaacgccagcctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgagccggaagctgatcaacggcatccgggacaagcagagcggcaagaccatcctggacttcctgaagagcgacggcttcgccaaccggaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaacagccgggagcggatgaagcggatcgaggagggcatcaaggagctgggcagccagatcctgaaggagcaccccgtggagaacacccagctgcagaacgagaagctgtacctgtactacctgcagaacggccgggacatgtacgtggaccaggagctggacatcaaccggctgagcgactacgacgtggaccacatcgtgccccagagcttcctgaaggacgacagcatcgacaacaaggtgctgacccggagcgacaagaaccggggcaagagcgacaacgtgcccagcgaggaggtggtgaagaagatgaagaactactggcggcagctgctgaacgccaagctgatcacccagcggaagttcgacaacctgaccaaggccgagcggggcggcctgagcgagctggacaaggccggcttcatcaagcggcagctggtggagacccggcagatcaccaagcacgtggcccagatcctggacagccggatgaacaccaagtacgacgagaacgacaagctgatccgggaggtgaaggtgatcaccctgaagagcaagctggtgagcgacttccggaaggacttccagttctacaaggtgcgggagatcaacaactaccaccacgcccacgacgcctacctgaacgccgtggtgggcaccgccctgatcaagaagtaccccaagctggagagcgagttcgtgtacggcgactacaaggtgtacgacgtgcggaagatgatcgccaagagcgagcaggagatcggcaaggccaccgccaagtacttcttctacagcaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgagcatgccccaggtgaacatcgtgaagaagaccgaggtgcagaccggcggcttcagcaaggagagcatcctgcccaagcggaacagcgacaagctgatcgcccggaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcggagcagcttcgagaagaaccccatcgacttcctggaggccaagggctacaaggaggtgaagaaggacctgatcatcaagctgcccaagtacagcctgttcgagctggagaacggccggaagcggatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgggtgatcctggccgacgccaacctggacaaggtgctgagcgcctacaacaagcaccgggacaagcccatccgggagcaggccgagaacatcatccacctgttcaccctgaccaacctgggcgcccccgccgccttcaagtacttcgacaccaccatcgaccggaagcggtacaccagcaccaaggaggtgctggacgccaccctgatccaccagagcatcaccggcctgtacgagacccggatcgacctgagccagctgggcggcgactga

SEQ ID NO: 122 - DNA, 4140 bp, Artificial Sequence
  Synthetic: Cas9 nickase ORF using low A/U codons of Table 4, with start and stop codons
atggacaagaagtacagcatcggcctggccatcggcaccaacagcgtgggctgggccgtgatcaccgacgagtacaaggtgcccagcaagaagttcaaggtgctgggcaacaccgaccggcacagcatcaagaagaacctgatcggcgccctgctgttcgacagcggcgagaccgccgaggccacccggctgaagcggaccgcccggcggcggtacacccggcggaagaaccggatctgctacctgcaggagatcttcagcaacgagatggccaaggtggacgacagcttcttccaccggctggaggagagcttcctggtggaggaggacaagaagcacgagcggcaccccatcttcggcaacatcgtggacgaggtggcctaccacgagaagtaccccaccatctaccacctgcggaagaagctggtggacagcaccgacaaggccgacctgcggctgatctacctggccctggcccacatgatcaagttccggggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccggctgagcaagagccggcggctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgggtgaacaccgagatcaccaaggcccccctgagcgccagcatgatcaagcggtacgacgagcaccaccaggacctgaccctgctgaaggccctggtgcggcagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgggaggacctgctgcggaagcagcggaccttcgacaacggcagcatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaacagccggttcgcctggatgacccggaagagcgaggagaccatcaccccctggaacttcgaggaggtggtggacaagggcgccagcgcccagagcttcatcgagcggatgaccaacttcgacaagaacctgcccaacgagaaggtgctgcccaagcacagcctgctgtacgagtacttcaccgtgtacaacgagctgaccaaggtgaagtacgtgaccgagggcatgcggaagcccgccttcctgagcggcgagcagaagaaggccatcgtggacctgctgttcaagaccaaccggaaggtgaccgtgaagcagctgaaggaggactacttcaagaagatcgagtgcttcgacagcgtggagatcagcggcgtggaggaccggttcaacgccagcctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgagccggaagctgatcaacggcatccgggacaagcagagcggcaagaccatcctggacttcctgaagagcgacggcttcgccaaccggaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaacagccgggagcggatgaagcggatcgaggagggcatcaaggagctgggcagccagatcctgaaggagcaccccgtggagaacacccagctgcagaacgagaagctgtacctgtactacctgcagaacggccgggacatgtacgtggaccaggagctggacatcaaccggctgagcgactacgacgtggaccacatcgtgccccagagcttcctgaaggacgacagcatcgacaacaaggtgctgacccggagcgacaagaaccggggcaagagcgacaacgtgcccagcgaggaggtggtgaagaagatgaagaactactggcggcagctgctgaacgccaagctgatcacccagcggaagttcgacaacctgaccaaggccgagcggggcggcctgagcgagctggacaaggccggcttcatcaagcggcagctggtggagacccggcagatcaccaagcacgtggcccagatcctggacagccggatgaacaccaagtacgacgagaacgacaagctgatccgggaggtgaaggtgatcaccctgaagagcaagctggtgagcgacttccggaaggacttccagttctacaaggtgcgggagatcaacaactaccaccacgcccacgacgcctacctgaacgccgtggtgggcaccgccctgatcaagaagtaccccaagctggagagcgagttcgtgtacggcgactacaaggtgtacgacgtgcggaagatgatcgccaagagcgagcaggagatcggcaaggccaccgccaagtacttcttctacagcaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgagcatgccccaggtgaacatcgtgaagaagaccgaggtgcagaccggcggcttcagcaaggagagcatcctgcccaagcggaacagcgacaagctgatcgcccggaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcggagcagcttcgagaagaaccccatcgacttcctggaggccaagggctacaaggaggtgaagaaggacctgatcatcaagctgcccaagtacagcctgttcgagctggagaacggccggaagcggatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgggtgatcctggccgacgccaacctggacaaggtgctgagcgcctacaacaagcaccgggacaagcccatccgggagcaggccgagaacatcatccacctgttcaccctgaccaacctgggcgcccccgccgccttcaagtacttcgacaccaccatcgaccggaagcggtacaccagcaccaaggaggtgctggacgccaccctgatccaccagagcatcaccggcctgtacgagacccggatcgacctgagccagctgggcggcgacggcggcggcagccccaagaagaagcggaaggtgtga

SEQ ID NO: 123 - DNA, 4179 bp, Artificial Sequence
  Synthetic: Cas9 nickase ORF using low A/U codons of Table 4, with two C-terminal NLS sequences and start and stop codons
atggacaagaagtacagcatcggcctggccatcggcaccaacagcgtgggctgggccgtgatcaccgacgagtacaaggtgcccagcaagaagttcaaggtgctgggcaacaccgaccggcacagcatcaagaagaacctgatcggcgccctgctgttcgacagcggcgagaccgccgaggccacccggctgaagcggaccgcccggcggcggtacacccggcggaagaaccggatctgctacctgcaggagatcttcagcaacgagatggccaaggtggacgacagcttcttccaccggctggaggagagcttcctggtggaggaggacaagaagcacgagcggcaccccatcttcggcaacatcgtggacgaggtggcctaccacgagaagtaccccaccatctaccacctgcggaagaagctggtggacagcaccgacaaggccgacctgcggctgatctacctggccctggcccacatgatcaagttccggggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccggctgagcaagagccggcggctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgggtgaacaccgagatcaccaaggcccccctgagcgccagcatgatcaagcggtacgacgagcaccaccaggacctgaccctgctgaaggccctggtgcggcagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgggaggacctgctgcggaagcagcggaccttcgacaacggcagcatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaacagccggttcgcctggatgacccggaagagcgaggagaccatcaccccctggaacttcgaggaggtggtggacaagggcgccagcgcccagagcttcatcgagcggatgaccaacttcgacaagaacctgcccaacgagaaggtgctgcccaagcacagcctgctgtacgagtacttcaccgtgtacaacgagctgaccaaggtgaagtacgtgaccgagggcatgcggaagcccgccttcctgagcggcgagcagaagaaggccatcgtggacctgctgttcaagaccaaccggaaggtgaccgtgaagcagctgaaggaggactacttcaagaagatcgagtgcttcgacagcgtggagatcagcggcgtggaggaccggttcaacgccagcctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgagccggaagctgatcaacggcatccgggacaagcagagcggcaagaccatcctggacttcctgaagagcgacggcttcgccaaccggaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaacagccgggagcggatgaagcggatcgaggagggcatcaaggagctgggcagccagatcctgaaggagcaccccgtggagaacacccagctgcagaacgagaagctgtacctgtactacctgcagaacggccgggacatgtacgtggaccaggagctggacatcaaccggctgagcgactacgacgtggaccacatcgtgccccagagcttcctgaaggacgacagcatcgacaacaaggtgctgacccggagcgacaagaaccggggcaagagcgacaacgtgcccagcgaggaggtggtgaagaagatgaagaactactggcggcagctgctgaacgccaagctgatcacccagcggaagttcgacaacctgaccaaggccgagcggggcggcctgagcgagctggacaaggccggcttcatcaagcggcagctggtggagacccggcagatcaccaagcacgtggcccagatcctggacagccggatgaacaccaagtacgacgagaacgacaagctgatccgggaggtgaaggtgatcaccctgaagagcaagctggtgagcgacttccggaaggacttccagttctacaaggtgcgggagatcaacaactaccaccacgcccacgacgcctacctgaacgccgtggtgggcaccgccctgatcaagaagtaccccaagctggagagcgagttcgtgtacggcgactacaaggtgtacgacgtgcggaagatgatcgccaagagcgagcaggagatcggcaaggccaccgccaagtacttcttctacagcaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgagcatgccccaggtgaacatcgtgaagaagaccgaggtgcagaccggcggcttcagcaaggagagcatcctgcccaagcggaacagcgacaagctgatcgcccggaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcggagcagcttcgagaagaaccccatcgacttcctggaggccaagggctacaaggaggtgaagaaggacctgatcatcaagctgcccaagtacagcctgttcgagctggagaacggccggaagcggatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgggtgatcctggccgacgccaacctggacaaggtgctgagcgcctacaacaagcaccgggacaagcccatccgggagcaggccgagaacatcatccacctgttcaccctgaccaacctgggcgcccccgccgccttcaagtacttcgacaccaccatcgaccggaagcggtacaccagcaccaaggaggtgctggacgccaccctgatccaccagagcatcaccggcctgtacgagacccggatcgacctgagccagctgggcggcgacggcagcggcagccccaagaagaagcggaaggtggacggcagccccaagaagaagcggaaggtggacagcggctga

SEQ ID NO: 124 - DNA, 4107 bp, Artificial Sequence
  Synthetic: Cas9 nickase ORF using low A/U codons of Table 4, with start and stop codons and no NLS
atggacaagaagtacagcatcggcctggccatcggcaccaacagcgtgggctgggccgtgatcaccgacgagtacaaggtgcccagcaagaagttcaaggtgctgggcaacaccgaccggcacagcatcaagaagaacctgatcggcgccctgctgttcgacagcggcgagaccgccgaggccacccggctgaagcggaccgcccggcggcggtacacccggcggaagaaccggatctgctacctgcaggagatcttcagcaacgagatggccaaggtggacgacagcttcttccaccggctggaggagagcttcctggtggaggaggacaagaagcacgagcggcaccccatcttcggcaacatcgtggacgaggtggcctaccacgagaagtaccccaccatctaccacctgcggaagaagctggtggacagcaccgacaaggccgacctgcggctgatctacctggccctggcccacatgatcaagttccggggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccggctgagcaagagccggcggctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgggtgaacaccgagatcaccaaggcccccctgagcgccagcatgatcaagcggtacgacgagcaccaccaggacctgaccctgctgaaggccctggtgcggcagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgggaggacctgctgcggaagcagcggaccttcgacaacggcagcatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaacagccggttcgcctggatgacccggaagagcgaggagaccatcaccccctggaacttcgaggaggtggtggacaagggcgccagcgcccagagcttcatcgagcggatgaccaacttcgacaagaacctgcccaacgagaaggtgctgcccaagcacagcctgctgtacgagtacttcaccgtgtacaacgagctgaccaaggtgaagtacgtgaccgagggcatgcggaagcccgccttcctgagcggcgagcagaagaaggccatcgtggacctgctgttcaagaccaaccggaaggtgaccgtgaagcagctgaaggaggactacttcaagaagatcgagtgcttcgacagcgtggagatcagcggcgtggaggaccggttcaacgccagcctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgagccggaagctgatcaacggcatccgggacaagcagagcggcaagaccatcctggacttcctgaagagcgacggcttcgccaaccggaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaacagccgggagcggatgaagcggatcgaggagggcatcaaggagctgggcagccagatcctgaaggagcaccccgtggagaacacccagctgcagaacgagaagctgtacctgtactacctgcagaacggccgggacatgtacgtggaccaggagctggacatcaaccggctgagcgactacgacgtggaccacatcgtgccccagagcttcctgaaggacgacagcatcgacaacaaggtgctgacccggagcgacaagaaccggggcaagagcgacaacgtgcccagcgaggaggtggtgaagaagatgaagaactactggcggcagctgctgaacgccaagctgatcacccagcggaagttcgacaacctgaccaaggccgagcggggcggcctgagcgagctggacaaggccggcttcatcaagcggcagctggtggagacccggcagatcaccaagcacgtggcccagatcctggacagccggatgaacaccaagtacgacgagaacgacaagctgatccgggaggtgaaggtgatcaccctgaagagcaagctggtgagcgacttccggaaggacttccagttctacaaggtgcgggagatcaacaactaccaccacgcccacgacgcctacctgaacgccgtggtgggcaccgccctgatcaagaagtaccccaagctggagagcgagttcgtgtacggcgactacaaggtgtacgacgtgcggaagatgatcgccaagagcgagcaggagatcggcaaggccaccgccaagtacttcttctacagcaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgagcatgccccaggtgaacatcgtgaagaagaccgaggtgcagaccggcggcttcagcaaggagagcatcctgcccaagcggaacagcgacaagctgatcgcccggaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcggagcagcttcgagaagaaccccatcgacttcctggaggccaagggctacaaggaggtgaagaaggacctgatcatcaagctgcccaagtacagcctgttcgagctggagaacggccggaagcggatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgggtgatcctggccgacgccaacctggacaaggtgctgagcgcctacaacaagcaccgggacaagcccatccgggagcaggccgagaacatcatccacctgttcaccctgaccaacctgggcgcccccgccgccttcaagtacttcgacaccaccatcgaccggaagcggtacaccagcaccaaggaggtgctggacgccaccctgatccaccagagcatcaccggcctgtacgagacccggatcgacctgagccagctgggcggcgactga

SEQ ID NO: 125 - DNA, 4140 bp, Artificial Sequence
  Synthetic: dCas9 ORF using low A/U codons of Table 4, with start and stop codons
atggacaagaagtacagcatcggcctggccatcggcaccaacagcgtgggctgggccgtgatcaccgacgagtacaaggtgcccagcaagaagttcaaggtgctgggcaacaccgaccggcacagcatcaagaagaacctgatcggcgccctgctgttcgacagcggcgagaccgccgaggccacccggctgaagcggaccgcccggcggcggtacacccggcggaagaaccggatctgctacctgcaggagatcttcagcaacgagatggccaaggtggacgacagcttcttccaccggctggaggagagcttcctggtggaggaggacaagaagcacgagcggcaccccatcttcggcaacatcgtggacgaggtggcctaccacgagaagtaccccaccatctaccacctgcggaagaagctggtggacagcaccgacaaggccgacctgcggctgatctacctggccctggcccacatgatcaagttccggggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccggctgagcaagagccggcggctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgggtgaacaccgagatcaccaaggcccccctgagcgccagcatgatcaagcggtacgacgagcaccaccaggacctgaccctgctgaaggccctggtgcggcagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgggaggacctgctgcggaagcagcggaccttcgacaacggcagcatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaacagccggttcgcctggatgacccggaagagcgaggagaccatcaccccctggaacttcgaggaggtggtggacaagggcgccagcgcccagagcttcatcgagcggatgaccaacttcgacaagaacctgcccaacgagaaggtgctgcccaagcacagcctgctgtacgagtacttcaccgtgtacaacgagctgaccaaggtgaagtacgtgaccgagggcatgcggaagcccgccttcctgagcggcgagcagaagaaggccatcgtggacctgctgttcaagaccaaccggaaggtgaccgtgaagcagctgaaggaggactacttcaagaagatcgagtgcttcgacagcgtggagatcagcggcgtggaggaccggttcaacgccagcctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgagccggaagctgatcaacggcatccgggacaagcagagcggcaagaccatcctggacttcctgaagagcgacggcttcgccaaccggaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaacagccgggagcggatgaagcggatcgaggagggcatcaaggagctgggcagccagatcctgaaggagcaccccgtggagaacacccagctgcagaacgagaagctgtacctgtactacctgcagaacggccgggacatgtacgtggaccaggagctggacatcaaccggctgagcgactacgacgtggacgccatcgtgccccagagcttcctgaaggacgacagcatcgacaacaaggtgctgacccggagcgacaagaaccggggcaagagcgacaacgtgcccagcgaggaggtggtgaagaagatgaagaactactggcggcagctgctgaacgccaagctgatcacccagcggaagttcgacaacctgaccaaggccgagcggggcggcctgagcgagctggacaaggccggcttcatcaagcggcagctggtggagacccggcagatcaccaagcacgtggcccagatcctggacagccggatgaacaccaagtacgacgagaacgacaagctgatccgggaggtgaaggtgatcaccctgaagagcaagctggtgagcgacttccggaaggacttccagttctacaaggtgcgggagatcaacaactaccaccacgcccacgacgcctacctgaacgccgtggtgggcaccgccctgatcaagaagtaccccaagctggagagcgagttcgtgtacggcgactacaaggtgtacgacgtgcggaagatgatcgccaagagcgagcaggagatcggcaaggccaccgccaagtacttcttctacagcaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgagcatgccccaggtgaacatcgtgaagaagaccgaggtgcagaccggcggcttcagcaaggagagcatcctgcccaagcggaacagcgacaagctgatcgcccggaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcggagcagcttcgagaagaaccccatcgacttcctggaggccaagggctacaaggaggtgaagaaggacctgatcatcaagctgcccaagtacagcctgttcgagctggagaacggccggaagcggatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgggtgatcctggccgacgccaacctggacaaggtgctgagcgcctacaacaagcaccgggacaagcccatccgggagcaggccgagaacatcatccacctgttcaccctgaccaacctgggcgcccccgccgccttcaagtacttcgacaccaccatcgaccggaagcggtacaccagcaccaaggaggtgctggacgccaccctgatccaccagagcatcaccggcctgtacgagacccggatcgacctgagccagctgggcggcgacggcggcggcagccccaagaagaagcggaaggtgtga

SEQ ID NO: 126 - DNA, 4179 bp, Artificial Sequence
  Synthetic: dCas9 ORF using low A/U codons of Table 4, with two C-terminal NLS sequences and start and stop codons
atggacaagaagtacagcatcggcctggccatcggcaccaacagcgtgggctgggccgtgatcaccgacgagtacaaggtgcccagcaagaagttcaaggtgctgggcaacaccgaccggcacagcatcaagaagaacctgatcggcgccctgctgttcgacagcggcgagaccgccgaggccacccggctgaagcggaccgcccggcggcggtacacccggcggaagaaccggatctgctacctgcaggagatcttcagcaacgagatggccaaggtggacgacagcttcttccaccggctggaggagagcttcctggtggaggaggacaagaagcacgagcggcaccccatcttcggcaacatcgtggacgaggtggcctaccacgagaagtaccccaccatctaccacctgcggaagaagctggtggacagcaccgacaaggccgacctgcggctgatctacctggccctggcccacatgatcaagttccggggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccggctgagcaagagccggcggctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgggtgaacaccgagatcaccaaggcccccctgagcgccagcatgatcaagcggtacgacgagcaccaccaggacctgaccctgctgaaggccctggtgcggcagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgggaggacctgctgcggaagcagcggaccttcgacaacggcagcatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaacagccggttcgcctggatgacccggaagagcgaggagaccatcaccccctggaacttcgaggaggtggtggacaagggcgccagcgcccagagcttcatcgagcggatgaccaacttcgacaagaacctgcccaacgagaaggtgctgcccaagcacagcctgctgtacgagtacttcaccgtgtacaacgagctgaccaaggtgaagtacgtgaccgagggcatgcggaagcccgccttcctgagcggcgagcagaagaaggccatcgtggacctgctgttcaagaccaaccggaaggtgaccgtgaagcagctgaaggaggactacttcaagaagatcgagtgcttcgacagcgtggagatcagcggcgtggaggaccggttcaacgccagcctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgagccggaagctgatcaacggcatccgggacaagcagagcggcaagaccatcctggacttcctgaagagcgacggcttcgccaaccggaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaacagccgggagcggatgaagcggatcgaggagggcatcaaggagctgggcagccagatcctgaaggagcaccccgtggagaacacccagctgcagaacgagaagctgtacctgtactacctgcagaacggccgggacatgtacgtggaccaggagctggacatcaaccggctgagcgactacgacgtggacgccatcgtgccccagagcttcctgaaggacgacagcatcgacaacaaggtgctgacccggagcgacaagaaccggggcaagagcgacaacgtgcccagcgaggaggtggtgaagaagatgaagaactactggcggcagctgctgaacgccaagctgatcacccagcggaagttcgacaacctgaccaaggccgagcggggcggcctgagcgagctggacaaggccggcttcatcaagcggcagctggtggagacccggcagatcaccaagcacgtggcccagatcctggacagccggatgaacaccaagtacgacgagaacgacaagctgatccgggaggtgaaggtgatcaccctgaagagcaagctggtgagcgacttccggaaggacttccagttctacaaggtgcgggagatcaacaactaccaccacgcccacgacgcctacctgaacgccgtggtgggcaccgccctgatcaagaagtaccccaagctggagagcgagttcgtgtacggcgactacaaggtgtacgacgtgcggaagatgatcgccaagagcgagcaggagatcggcaaggccaccgccaagtacttcttctacagcaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgagcatgccccaggtgaacatcgtgaagaagaccgaggtgcagaccggcggcttcagcaaggagagcatcctgcccaagcggaacagcgacaagctgatcgcccggaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcggagcagcttcgagaagaaccccatcgacttcctggaggccaagggctacaaggaggtgaagaaggacctgatcatcaagctgcccaagtacagcctgttcgagctggagaacggccggaagcggatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgggtgatcctggccgacgccaacctggacaaggtgctgagcgcctacaacaagcaccgggacaagcccatccgggagcaggccgagaacatcatccacctgttcaccctgaccaacctgggcgcccccgccgccttcaagtacttcgacaccaccatcgaccggaagcggtacaccagcaccaaggaggtgctggacgccaccctgatccaccagagcatcaccggcctgtacgagacccggatcgacctgagccagctgggcggcgacggcagcggcagccccaagaagaagcggaaggtggacggcagccccaagaagaagcggaaggtggacagcggctga

SEQ ID NO: 127 - DNA, 4107 bp, Artificial Sequence
  Synthetic: dCas9 ORF using low A/U codons of Table 4, with start and stop codons and no NLS
atggacaagaagtacagcatcggcctggccatcggcaccaacagcgtgggctgggccgtgatcaccgacgagtacaaggtgcccagcaagaagttcaaggtgctgggcaacaccgaccggcacagcatcaagaagaacctgatcggcgccctgctgttcgacagcggcgagaccgccgaggccacccggctgaagcggaccgcccggcggcggtacacccggcggaagaaccggatctgctacctgcaggagatcttcagcaacgagatggccaaggtggacgacagcttcttccaccggctggaggagagcttcctggtggaggaggacaagaagcacgagcggcaccccatcttcggcaacatcgtggacgaggtggcctaccacgagaagtaccccaccatctaccacctgcggaagaagctggtggacagcaccgacaaggccgacctgcggctgatctacctggccctggcccacatgatcaagttccggggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccggctgagcaagagccggcggctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgggtgaacaccgagatcaccaaggcccccctgagcgccagcatgatcaagcggtacgacgagcaccaccaggacctgaccctgctgaaggccctggtgcggcagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgggaggacctgctgcggaagcagcggaccttcgacaacggcagcatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaacagccggttcgcctggatgacccggaagagcgaggagaccatcaccccctggaacttcgaggaggtggtggacaagggcgccagcgcccagagcttcatcgagcggatgaccaacttcgacaagaacctgcccaacgagaaggtgctgcccaagcacagcctgctgtacgagtacttcaccgtgtacaacgagctgaccaaggtgaagtacgtgaccgagggcatgcggaagcccgccttcctgagcggcgagcagaagaaggccatcgtggacctgctgttcaagaccaaccggaaggtgaccgtgaagcagctgaaggaggactacttcaagaagatcgagtgcttcgacagcgtggagatcagcggcgtggaggaccggttcaacgccagcctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgagccggaagctgatcaacggcatccgggacaagcagagcggcaagaccatcctggacttcctgaagagcgacggcttcgccaaccggaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaacagccgggagcggatgaagcggatcgaggagggcatcaaggagctgggcagccagatcctgaaggagcaccccgtggagaacacccagctgcagaacgagaagctgtacctgtactacctgcagaacggccgggacatgtacgtggaccaggagctggacatcaaccggctgagcgactacgacgtggacgccatcgtgccccagagcttcctgaaggacgacagcatcgacaacaaggtgctgacccggagcgacaagaaccggggcaagagcgacaacgtgcccagcgaggaggtggtgaagaagatgaagaactactggcggcagctgctgaacgccaagctgatcacccagcggaagttcgacaacctgaccaaggccgagcggggcggcctgagcgagctggacaaggccggcttcatcaagcggcagctggtggagacccggcagatcaccaagcacgtggcccagatcctggacagccggatgaacaccaagtacgacgagaacgacaagctgatccgggaggtgaaggtgatcaccctgaagagcaagctggtgagcgacttccggaaggacttccagttctacaaggtgcgggagatcaacaactaccaccacgcccacgacgcctacctgaacgccgtggtgggcaccgccctgatcaagaagtaccccaagctggagagcgagttcgtgtacggcgactacaaggtgtacgacgtgcggaagatgatcgccaagagcgagcaggagatcggcaaggccaccgccaagtacttcttctacagcaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgagcatgccccaggtgaacatcgtgaagaagaccgaggtgcagaccggcggcttcagcaaggagagcatcctgcccaagcggaacagcgacaagctgatcgcccggaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcggagcagcttcgagaagaaccccatcgacttcctggaggccaagggctacaaggaggtgaagaaggacctgatcatcaagctgcccaagtacagcctgttcgagctggagaacggccggaagcggatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgggtgatcctggccgacgccaacctggacaaggtgctgagcgcctacaacaagcaccgggacaagcccatccgggagcaggccgagaacatcatccacctgttcaccctgaccaacctgggcgcccccgccgccttcaagtacttcgacaccaccatcgaccggaagcggtacaccagcaccaaggaggtgctggacgccaccctgatccaccagagcatcaccggcctgtacgagacccggatcgacctgagccagctgggcggcgactga

SEQ ID NO: 128 - DNA, 3312 bp, Artificial Sequence
  Synthetic: Nme Cas9 ORF using low A codons of Table 4, with start and stop codons
atggccgccttcaagcccaactccatcaactacatcctgggcctggacatcggcatcgcctccgtgggctgggccatggtggagatcgacgaggaggagaaccccatccggctgatcgacctgggcgtgcgggtgttcgagcgggccgaggtgcccaagaccggcgactccctggccatggcccggcggctggcccggtccgtgcggcggctgacccggcggcgggcccaccggctgctgcggacccggcggctgctgaagcgggagggcgtgctgcaggccgccaacttcgacgagaacggcctgatcaagtccctgcccaacaccccctggcagctgcgggccgccgccctggaccggaagctgacccccctggagtggtccgccgtgctgctgcacctgatcaagcaccggggctacctgtcccagcggaagaacgagggcgagaccgccgacaaggagctgggcgccctgctgaagggcgtggccggcaacgcccacgccctgcagaccggcgacttccggacccccgccgagctggccctgaacaagttcgagaaggagtccggccacatccggaaccagcggtccgactactcccacaccttctcccggaaggacctgcaggccgagctgatcctgctgttcgagaagcagaaggagttcggcaacccccacgtgtccggcggcctgaaggagggcatcgagaccctgctgatgacccagcggcccgccctgtccggcgacgccgtgcagaagatgctgggccactgcaccttcgagcccgccgagcccaaggccgccaagaacacctacaccgccgagcggttcatctggctgaccaagctgaacaacctgcggatcctggagcagggctccgagcggcccctgaccgacaccgagcgggccaccctgatggacgagccctaccggaagtccaagctgacctacgcccaggcccggaagctgctgggcctggaggacaccgccttcttcaagggcctgcggtacggcaaggacaacgccgaggcctccaccctgatggagatgaaggcctaccacgccatctcccgggccctggagaaggagggcctgaaggacaagaagtcccccctgaacctgtcccccgagctgcaggacgagatcggcaccgccttctccctgttcaagaccgacgaggacatcaccggccggctgaaggaccggatccagcccgagatcctggaggccctgctgaagcacatctccttcgacaagttcgtgcagatctccctgaaggccctgcggcggatcgtgcccctgatggagcagggcaagcggtacgacgaggcctgcgccgagatctacggcgaccactacggcaagaagaacaccgaggagaagatctacctgccccccatccccgccgacgagatccggaaccccgtggtgctgcgggccctgtcccaggcccggaaggtgatcaacggcgtggtgcggcggtacggctcccccgcccggatccacatcgagaccgcccgggaggtgggcaagtccttcaaggaccggaaggagatcgagaagcggcaggaggagaaccggaaggaccgggagaaggccgccgccaagttccgggagtacttccccaacttcgtgggcgagcccaagtccaaggacatcctgaagctgcggctgtacgagcagcagcacggcaagtgcctgtactccggcaaggagatcaacctgggccggctgaacgagaagggctacgtggagatcgaccacgccctgcccttctcccggacctgggacgactccttcaacaacaaggtgctggtgctgggctccgagaaccagaacaagggcaaccagaccccctacgagtacttcaacggcaaggacaactcccgggagtggcaggagttcaaggcccgggtggagacctcccggttcccccggtccaagaagcagcggatcctgctgcagaagttcgacgaggacggcttcaaggagcggaacctgaacgacacccggtacgtgaaccggttcctgtgccagttcgtggccgaccggatgcggctgaccggcaagggcaagaagcgggtgttcgcctccaacggccagatcaccaacctgctgcggggcttctggggcctgcggaaggtgcgggccgagaacgaccggcaccacgccctggacgccgtggtggtggcctgctccaccgtggccatgcagcagaagatcacccggttcgtgcggtacaaggagatgaacgccttcgacggcaagaccatcgacaaggagaccggcgaggtgctgcaccagaagacccacttcccccagccctgggagttcttcgcccaggaggtgatgatccgggtgttcggcaagcccgacggcaagcccgagttcgaggaggccgacaccctggagaagctgcggaccctgctggccgagaagctgtcctcccggcccgaggccgtgcacgagtacgtgacccccctgttcgtgtcccgggcccccaaccggaagatgtccggccagggccacatggagaccgtgaagtccgccaagcggctggacgagggcgtgtccgtgctgcgggtgcccctgacccagctgaagctgaaggacctggagaagatggtgaaccgggagcgggagcccaagctgtacgaggccctgaaggcccggctggaggcccacaaggacgaccccgccaaggccttcgccgagcccttctacaagtacgacaaggccggcaaccggacccagcaggtgaaggccgtgcgggtggagcaggtgcagaagaccggcgtgtgggtgcggaaccacaacggcatcgccgacaacgccaccatggtgcgggtggacgtgttcgagaagggcgacaagtactacctggtgcccatctactcctggcaggtggccaagggcatcctgcccgaccgggccgtggtgcagggcaaggacgaggaggactggcagctgatcgacgactccttcaacttcaagttctccctgcaccccaacgacctggtggaggtgatcaccaagaaggcccggatgttcggctacttcgcctcctgccaccggggcaccggcaacatcaacatccggatccacgacctggaccacaagatcggcaagaacggcatcctggagggcatcggcgtgaagaccgccctgtccttccagaagtaccagatcgacgagctgggcaaggagatccggccctgccggctgaagaagcggccccccgtgcggtccggcaagcggaccgccgacggctccgagttcgagtcccccaagaagaagcggaaggtggagtga

SEQ ID NO: 129 - DNA, 3312 bp, Artificial Sequence
  Synthetic: Nme Cas9 ORF using low A/U codons of Table 4, with start and stop codons
atggccgccttcaagcccaacagcatcaactacatcctgggcctggacatcggcatcgccagcgtgggctgggccatggtggagatcgacgaggaggagaaccccatccggctgatcgacctgggcgtgcgggtgttcgagcgggccgaggtgcccaagaccggcgacagcctggccatggcccggcggctggcccggagcgtgcggcggctgacccggcggcgggcccaccggctgctgcggacccggcggctgctgaagcgggagggcgtgctgcaggccgccaacttcgacgagaacggcctgatcaagagcctgcccaacaccccctggcagctgcgggccgccgccctggaccggaagctgacccccctggagtggagcgccgtgctgctgcacctgatcaagcaccggggctacctgagccagcggaagaacgagggcgagaccgccgacaaggagctgggcgccctgctgaagggcgtggccggcaacgcccacgccctgcagaccggcgacttccggacccccgccgagctggccctgaacaagttcgagaaggagagcggccacatccggaaccagcggagcgactacagccacaccttcagccggaaggacctgcaggccgagctgatcctgctgttcgagaagcagaaggagttcggcaacccccacgtgagcggcggcctgaaggagggcatcgagaccctgctgatgacccagcggcccgccctgagcggcgacgccgtgcagaagatgctgggccactgcaccttcgagcccgccgagcccaaggccgccaagaacacctacaccgccgagcggttcatctggctgaccaagctgaacaacctgcggatcctggagcagggcagcgagcggcccctgaccgacaccgagcgggccaccctgatggacgagccctaccggaagagcaagctgacctacgcccaggcccggaagctgctgggcctggaggacaccgccttcttcaagggcctgcggtacggcaaggacaacgccgaggccagcaccctgatggagatgaaggcctaccacgccatcagccgggccctggagaaggagggcctgaaggacaagaagagccccctgaacctgagccccgagctgcaggacgagatcggcaccgccttcagcctgttcaagaccgacgaggacatcaccggccggctgaaggaccggatccagcccgagatcctggaggccctgctgaagcacatcagcttcgacaagttcgtgcagatcagcctgaaggccctgcggcggatcgtgcccctgatggagcagggcaagcggtacgacgaggcctgcgccgagatctacggcgaccactacggcaagaagaacaccgaggagaagatctacctgccccccatccccgccgacgagatccggaaccccgtggtgctgcgggccctgagccaggcccggaaggtgatcaacggcgtggtgcggcggtacggcagccccgcccggatccacatcgagaccgcccgggaggtgggcaagagcttcaaggaccggaaggagatcgagaagcggcaggaggagaaccggaaggaccgggagaaggccgccgccaagttccgggagtacttccccaacttcgtgggcgagcccaagagcaaggacatcctgaagctgcggctgtacgagcagcagcacggcaagtgcctgtacagcggcaaggagatcaacctgggccggctgaacgagaagggctacgtggagatcgaccacgccctgcccttcagccggacctgggacgacagcttcaacaacaaggtgctggtgctgggcagcgagaaccagaacaagggcaaccagaccccctacgagtacttcaacggcaaggacaacagccgggagtggcaggagttcaaggcccgggtggagaccagccggttcccccggagcaagaagcagcggatcctgctgcagaagttcgacgaggacggcttcaaggagcggaacctgaacgacacccggtacgtgaaccggttcctgtgccagttcgtggccgaccggatgcggctgaccggcaagggcaagaagcgggtgttcgccagcaacggccagatcaccaacctgctgcggggcttctggggcctgcggaaggtgcgggccgagaacgaccggcaccacgccctggacgccgtggtggtggcctgcagcaccgtggccatgcagcagaagatcacccggttcgtgcggtacaaggagatgaacgccttcgacggcaagaccatcgacaaggagaccggcgaggtgctgcaccagaagacccacttcccccagccctgggagttcttcgcccaggaggtgatgatccgggtgttcggcaagcccgacggcaagcccgagttcgaggaggccgacaccctggagaagctgcggaccctgctggccgagaagctgagcagccggcccgaggccgtgcacgagtacgtgacccccctgttcgtgagccgggcccccaaccggaagatgagcggccagggccacatggagaccgtgaagagcgccaagcggctggacgagggcgtgagcgtgctgcgggtgcccctgacccagctgaagctgaaggacctggagaagatggtgaaccgggagcgggagcccaagctgtacgaggccctgaaggcccggctggaggcccacaaggacgaccccgccaaggccttcgccgagcccttctacaagtacgacaaggccggcaaccggacccagcaggtgaaggccgtgcgggtggagcaggtgcagaagaccggcgtgtgggtgcggaaccacaacggcatcgccgacaacgccaccatggtgcgggtggacgtgttcgagaagggcgacaagtactacctggtgcccatctacagctggcaggtggccaagggcatcctgcccgaccgggccgtggtgcagggcaaggacgaggaggactggcagctgatcgacgacagcttcaacttcaagttcagcctgcaccccaacgacctggtggaggtgatcaccaagaaggcccggatgttcggctacttcgccagctgccaccggggcaccggcaacatcaacatccggatccacgacctggaccacaagatcggcaagaacggcatcctggagggcatcggcgtgaagaccgccctgagcttccagaagtaccagatcgacgagctgggcaaggagatccggccctgccggctgaagaagcggccccccgtgcggagcggcaagcggaccgccgacggcagcgagttcgagagccccaagaagaagcggaaggtggagtga

SEQ ID NO: 130 - DNA, 4146 bp, Artificial Sequence
  Synthetic: Open reading frame for Cas9 with NLS1, with start and stop codons
atggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcctggcagcaaagagaagcagaacaacatag

SEQ ID NO: 131 - DNA, 4146 bp, Artificial Sequence
  Synthetic: Open reading frame for Cas9 with NLS2, with start and stop codons
atggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagccaggcagcaaagagaagcagaacaacatag

SEQ ID NO: 132 - DNA, 4149 bp, Artificial Sequence
  Synthetic: Open reading frame for Cas9 with NLS3, with start and stop codons
atggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcccggcaccggcaaagagagaaagaacaacatag

SEQ ID NO: 133 - DNA, 4146 bp, Artificial Sequence
  Synthetic: Open reading frame for Cas9 with NLS4, with start and stop codons
atggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagccaggcagcaaagagaccgagaacaacatag

SEQ ID NO: 134 - DNA, 4146 bp, Artificial Sequence
  Synthetic: Open reading frame for Cas9 with NLS5, with start and stop codons
atggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcagagcagcaaagagaccgagaacaacatag

SEQ ID NO: 135 - DNA, 4152 bp, Artificial Sequence
  Synthetic: Open reading frame for Cas9 with NLS6, with start and stop codons
atggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcgcagcagcaaagagaagctggagcatggcagcatag

SEQ ID NO: 136 - DNA, 4152 bp, Artificial Sequence
  Synthetic: Open reading frame for Cas9 with NLS7, with start and stop codons
atggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcgcagcagcaaagagagtctggagcatggcattctag

SEQ ID NO: 137 - DNA, 4152 bp, Artificial Sequence
  Synthetic: Open reading frame for Cas9 with NLS8, with start and stop codons
atggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcgcagcagcaaagagaagctggagcatggcattctag

SEQ ID NO: 138 - DNA, 4149 bp, Artificial Sequence
  Synthetic: Open reading frame for Cas9 with NLS9, with start and stop codons
atggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcgcagcagcaaagagaaagtacttcgcagcatag

SEQ ID NO: 139 - DNA, 4149 bp, Artificial Sequence
  Synthetic: Open reading frame for Cas9 with NLS10, with start and stop codons
atggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcagagcagcaaagagaaaggcattcgcagcatag

SEQ ID NO: 140 - DNA, 4149 bp, Artificial Sequence
  Synthetic: Open reading frame for Cas9 with NLS11, with start and stop codons
atggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcagagcagcaaagagaaagtacttcgcagtctag

SEQ ID NO: 141 - DNA, 4128 bp, Artificial Sequence
  Synthetic: Cas9 ORF using codons with generally high expression in humans (no start or stop codons; suitable for inclusion in fusion protein coding sequence)
cctaagaaaaagcggaaggtcgacggggataagaagtactcaatcgggctggatatcggaactaattccgtgggttgggcagtgatcacggatgaatacaaagtgccgtccaagaagttcaaggtcctggggaacaccgatagacacagcatcaagaaaaatctcatcggagccctgctgtttgactccggcgaaaccgcagaagcgacccggctcaaacgtaccgcgaggcgacgctacacccggcggaagaatcgcatctgctatctgcaagagatcttttcgaacgaaatggcaaaggtcgacgacagcttcttccaccgcctggaagaatctttcctggtggaggaggacaagaagcatgaacggcatcctatctttggaaacatcgtcgacgaagtggcgtaccacgaaaagtacccgaccatctaccatctgcggaagaagttggttgactcaactgacaaggccgacctcagattgatctacttggccctcgcccatatgatcaaattccgcggacacttcctgatcgaaggcgatctgaaccctgataactccgacgtggataagcttttcattcaactggtgcagacctacaaccaactgttcgaagaaaacccaatcaatgctagcggcgtcgatgccaaggccatcctgtccgcccggctgtcgaagtcgcggcgcctcgaaaacctgatcgcacagctgccgggagagaaaaagaacggacttttcggcaacttgatcgctctctcactgggactcactcccaatttcaagtccaattttgacctggccgaggacgcgaagctgcaactctcaaaggacacctacgacgacgacttggacaatttgctggcacaaattggcgatcagtacgcggatctgttccttgccgctaagaacctttcggacgcaatcttgctgtccgatatcctgcgcgtgaacaccgaaataaccaaagcgccgcttagcgcctcgatgattaagcggtacgacgagcatcaccaggatctcacgctgctcaaagcgctcgtgagacagcaactgcctgaaaagtacaaggagatcttcttcgaccagtccaagaatgggtacgcagggtacatcgatggaggcgctagccaggaagagttctataagttcatcaagccaatcctggaaaagatggacggaaccgaagaactgctggtcaagctgaacagggaggatctgctccggaaacagagaacctttgacaacggatccattccccaccagatccatctgggtgagctgcacgccatcttgcggcgccaggaggacttttacccattcctcaaggacaaccgggaaaagatcgagaaaattctgacgttccgcatcccgtattacgtgggcccactggcgcgcggcaattcgcgcttcgcgtggatgactagaaaatcagaggaaaccatcactccttggaatttcgaggaagttgtggataagggagcttcggcacaaagcttcatcgaacgaatgaccaacttcgacaagaatctcccaaacgagaaggtgcttcctaagcacagcctcctttacgaatacttcactgtctacaacgaactgactaaagtgaaatacgttactgaaggaatgaggaagccggcctttctgtccggagaacagaagaaagcaattgtcgatctgctgttcaagaccaaccgcaaggtgaccgtcaagcagcttaaagaggactacttcaagaagatcgagtgtttcgactcagtggaaatcagcggggtggaggacagattcaacgcttcgctgggaacctatcatgatctcctgaagatcatcaaggacaaggacttccttgacaacgaggagaacgaggacatcctggaagatatcgtcctgaccttgacccttttcgaggatcgcgagatgatcgaggagaggcttaagacctacgctcatctcttcgacgataaggtcatgaaacaactcaagcgccgccggtacactggttggggccgcctctcccgcaagctgatcaacggtattcgcgataaacagagcggtaaaactatcctggatttcctcaaatcggatggcttcgctaatcgtaacttcatgcaattgatccacgacgacagcctgacctttaaggaggacatccaaaaagcacaagtgtccggacagggagactcactccatgaacacatcgcgaatctggccggttcgccggcgattaagaagggaattctgcaaactgtgaaggtggtcgacgagctggtgaaggtcatgggacggcacaaaccggagaatatcgtgattgaaatggcccgagaaaaccagactacccagaagggccagaaaaactcccgcgaaaggatgaagcggatcgaagaaggaatcaaggagctgggcagccagatcctgaaagagcacccggtggaaaacacgcagctgcagaacgagaagctctacctgtactatttgcaaaatggacgggacatgtacgtggaccaagagctggacatcaatcggttgtctgattacgacgtggaccacatcgttccacagtcctttctgaaggatgactcgatcgataacaaggtgttgactcgcagcgacaagaacagagggaagtcagataatgtgccatcggaggaggtcgtgaagaagatgaagaattactggcggcagctcctgaatgcgaagctgattacccagagaaagtttgacaatctcactaaagccgagcgcggcggactctcagagctggataaggctggattcatcaaacggcagctggtcgagactcggcagattaccaagcacgtggcgcagatcttggactcccgcatgaacactaaatacgacgagaacgataagctcatccgggaagtgaaggtgattaccctgaaaagcaaacttgtgtcggactttcggaaggactttcagttttacaaagtgagagaaatcaacaactaccatcacgcgcatgacgcatacctcaacgctgtggtcggtaccgccctgatcaaaaagtaccctaaacttgaatcggagtttgtgtacggagactacaaggtctacgacgtgaggaagatgatagccaagtccgaacaggaaatcgggaaagcaactgcgaaatacttcttttactcaaacatcatgaactttttcaagactgaaattacgctggccaatggagaaatcaggaagaggccactgatcgaaactaacggagaaacgggcgaaatcgtgtgggacaagggcagggacttcgcaactgttcgcaaagtgctctctatgccgcaagtcaatattgtgaagaaaaccgaagtgcaaaccggcggattttcaaaggaatcgatcctcccaaagagaaatagcgacaagctcattgcacgcaagaaagactgggacccgaagaagtacggaggattcgattcgccgactgtcgcatactccgtcctcgtggtggccaaggtggagaagggaaagagcaaaaagctcaaatccgtcaaagagctgctggggattaccatcatggaacgatcctcgttcgagaagaacccgattgatttcctcgaggcgaagggttacaaggaggtgaagaaggatctgatcatcaaactccccaagtactcactgttcgaactggaaaatggtcggaagcgcatgctggcttcggccggagaactccaaaaaggaaatgagctggccttgcctagcaagtacgtcaacttcctctatcttgcttcgcactacgaaaaactcaaagggtcaccggaagataacgaacagaagcagcttttcgtggagcagcacaagcattatctggatgaaatcatcgaacaaatctccgagttttcaaagcgcgtgatcctcgccgacgccaacctcgacaaagtcctgtcggcctacaataagcatagagataagccgatcagagaacaggccgagaacattatccacttgttcaccctgactaacctgggagccccagccgccttcaagtacttcgatactactatcgatcgcaaaagatacacgtccaccaaggaagttctggacgcgaccctgatccaccaaagcatcactggactctacgaaactaggatcgatctgtcgcagctgggtggcgat

SEQ ID NO: 142 - DNA, 4134 bp, Artificial Sequence
  Synthetic: Cas9 ORF using long half life codons of Table 4 (no start or stop codons; suitable for inclusion in fusion protein coding sequence)
gacaagaagtactctatcggtttggacatcggtaccaactctgtcggttgggccgtcatcaccgacgaatacaaggtcccatctaagaagttcaaggtcttgggtaacaccgacagacactctatcaagaagaacttgatcggtgccttgttgttcgactctggtgaaaccgccgaagccaccagattgaagagaaccgccagaagaagatacaccagaagaaagaacagaatctgctacttgcaagaaatcttctctaacgaaatggccaaggtcgacgactctttcttccacagattggaagaatctttcttggtcgaagaagacaagaagcacgaaagacacccaatcttcggtaacatcgtcgacgaagtcgcctaccacgaaaagtacccaaccatctaccacttgagaaagaagttggtcgactctaccgacaaggccgacttgagattgatctacttggccttggcccacatgatcaagttcagaggtcacttcttgatcgaaggtgacttgaacccagacaactctgacgtcgacaagttgttcatccaattggtccaaacctacaaccaattgttcgaagaaaacccaatcaacgcctctggtgtcgacgccaaggccatcttgtctgccagattgtctaagagcagaagattggaaaacttgatcgcccaattgccaggtgaaaagaagaacggtttgttcggtaacttgatcgccttgtctttgggtttgaccccaaacttcaagtctaacttcgacttggccgaagacgccaagttgcaattgtctaaggacacctacgacgacgacttggacaacttgttggcccaaatcggtgaccaatacgccgacttgttcttggccgccaagaacttgtctgacgccatcttgttgtctgacatcttgagagtcaacaccgaaatcaccaaggccccattgtctgcctctatgatcaagagatacgacgaacaccaccaagacttgaccttgttgaaggccttggtcagacaacaattgccagaaaagtacaaggaaatcttcttcgaccaatctaagaacggttacgccggttacatcgacggtggtgcctctcaagaagaattctacaagttcatcaagccaatcttggaaaagatggacggtaccgaagaattgttggtcaagttgaacagagaagacttgttgagaaagcaaagaaccttcgacaacggttctatcccacaccaaatccacttgggtgaattgcacgccatcttgagaagacaagaagacttctacccattcttgaaggacaacagagaaaagatcgaaaagatcttgaccttcagaatcccatactacgtcggtccattggccagaggtaacagcagattcgcctggatgaccagaaagtctgaagaaaccatcaccccatggaacttcgaagaagtcgtcgacaagggtgcctctgcccaatctttcatcgaaagaatgaccaacttcgacaagaacttgccaaacgaaaaggtcttgccaaagcactctttgttgtacgaatacttcaccgtctacaacgaattgaccaaggtcaagtacgtcaccgaaggtatgagaaagccagccttcttgtctggtgaacaaaagaaggccatcgtcgacttgttgttcaagaccaacagaaaggtcaccgtcaagcaattgaaggaagactacttcaagaagatcgaatgcttcgactctgtcgaaatctctggtgtcgaagacagattcaacgcctctttgggtacctaccacgacttgttgaagatcatcaaggacaaggacttcttggacaacgaagaaaacgaagacatcttggaagacatcgtcttgaccttgaccttgttcgaagacagagaaatgatcgaagaaagattgaagacctacgcccacttgttcgacgacaaggtcatgaagcaattgaagagaagaagatacaccggttggggtagattgagcagaaagttgatcaacggtatcagagacaagcaatctggtaagaccatcttggacttcttgaagtctgacggtttcgccaacagaaacttcatgcaattgatccacgacgactctttgaccttcaaggaagacatccaaaaggcccaagtctctggtcaaggtgactctttgcacgaacacatcgccaacttggccggttctccagccatcaagaagggtatcttgcaaaccgtcaaggtcgtcgacgaattggtcaaggtcatgggtagacacaagccagaaaacatcgtcatcgaaatggccagagaaaaccaaaccacccaaaagggtcaaaagaacagcagagaaagaatgaagagaatcgaagaaggtatcaaggaattgggttctcaaatcttgaaggaacacccagtcgaaaacacccaattgcaaaacgaaaagttgtacttgtactacttgcaaaacggtagagacatgtacgtcgaccaagaattggacatcaacagattgtctgactacgacgtcgaccacatcgtcccacaatctttcttgaaggacgactctatcgacaacaaggtcttgaccagatctgacaagaacagaggtaagtctgacaacgtcccatctgaagaagtcgtcaagaagatgaagaactactggagacaattgttgaacgccaagttgatcacccaaagaaagttcgacaacttgaccaaggccgaaagaggtggtttgtctgaattggacaaggccggtttcatcaagagacaattggtcgaaaccagacaaatcaccaagcacgtcgcccaaatcttggacagcagaatgaacaccaagtacgacgaaaacgacaagttgatcagagaagtcaaggtcatcaccttgaagtctaagttggtctctgacttcagaaaggacttccaattctacaaggtcagagaaatcaacaactaccaccacgcccacgacgcctacttgaacgccgtcgtcggtaccgccttgatcaagaagtacccaaagttggaatctgaattcgtctacggtgactacaaggtctacgacgtcagaaagatgatcgccaagtctgaacaagaaatcggtaaggccaccgccaagtacttcttctactctaacatcatgaacttcttcaagaccgaaatcaccttggccaacggtgaaatcagaaagagaccattgatcgaaaccaacggtgaaaccggtgaaatcgtctgggacaagggtagagacttcgccaccgtcagaaaggtcttgtctatgccacaagtcaacatcgtcaagaagaccgaagtccaaaccggtggtttctctaaggaatctatcttgccaaagagaaactctgacaagttgatcgccagaaagaaggactgggacccaaagaagtacggtggtttcgactctccaaccgtcgcctactctgtcttggtcgtcgccaaggtcgaaaagggtaagtctaagaagttgaagtctgtcaaggaattgttgggtatcaccatcatggaaagatcttctttcgaaaagaacccaatcgacttcttggaagccaagggttacaaggaagtcaagaaggacttgatcatcaagttgccaaagtactctttgttcgaattggaaaacggtagaaagagaatgttggcctctgccggtgaattgcaaaagggtaacgaattggccttgccatctaagtacgtcaacttcttgtacttggcctctcactacgaaaagttgaagggttctccagaagacaacgaacaaaagcaattgttcgtcgaacaacacaagcactacttggacgaaatcatcgaacaaatctctgaattctctaagagagtcatcttggccgacgccaacttggacaaggtcttgtctgcctacaacaagcacagagacaagccaatcagagaacaagccgaaaacatcatccacttgttcaccttgaccaacttgggtgccccagccgccttcaagtacttcgacaccaccatcgacagaaagagatacacctctaccaaggaagtcttggacgccaccttgatccaccaatctatcaccggtttgtacgaaaccagaatcgacttgtctcaattgggtggtgacggtggtggttctccaaagaagaagagaaaggtc

SEQ ID NO: 143 - DNA, 4134 bp, Artificial Sequence
  Synthetic: Cas9 ORF using U rich codons of Table 4 (no start or stop codons; suitable for inclusion in fusion protein coding sequence)
gataaaaaatattctattggtttagatattggtactaattctgttggttgggctgttattactgatgaatataaagttccttctaaaaaatttaaagttttaggtaatactgatcgtcattctattaaaaaaaatttaattggtgctttattatttgattctggtgaaactgctgaagctactcgtttaaaacgtactgctcgtcgtcgttatactcgtcgtaaaaatcgtatttgttatttacaagaaattttttctaatgaaatggctaaagttgatgattctttttttcatcgtttagaagaatcttttttagttgaagaagataaaaaacatgaacgtcatcctatttttggtaatattgttgatgaagttgcttatcatgaaaaatatcctactatttatcatttacgtaaaaaattagttgattctactgataaagctgatttacgtttaatttatttagctttagctcatatgattaaatttcgtggtcattttttaattgaaggtgatttaaatcctgataattctgatgttgataaattatttattcaattagttcaaacttataatcaattatttgaagaaaatcctattaatgcttctggtgttgatgctaaagctattttatctgctcgtttatctaaatctcgtcgtttagaaaatttaattgctcaattacctggtgaaaaaaaaaatggtttatttggtaatttaattgctttatctttaggtttaactcctaattttaaatctaattttgatttagctgaagatgctaaattacaattatctaaagatacttatgatgatgatttagataatttattagctcaaattggtgatcaatatgctgatttatttttagctgctaaaaatttatctgatgctattttattatctgatattttacgtgttaatactgaaattactaaagctcctttatctgcttctatgattaaacgttatgatgaacatcatcaagatttaactttattaaaagctttagttcgtcaacaattacctgaaaaatataaagaaattttttttgatcaatctaaaaatggttatgctggttatattgatggtggtgcttctcaagaagaattttataaatttattaaacctattttagaaaaaatggatggtactgaagaattattagttaaattaaatcgtgaagatttattacgtaaacaacgtacttttgataatggttctattcctcatcaaattcatttaggtgaattacatgctattttacgtcgtcaagaagatttttatccttttttaaaagataatcgtgaaaaaattgaaaaaattttaacttttcgtattccttattatgttggtcctttagctcgtggtaattctcgttttgcttggatgactcgtaaatctgaagaaactattactccttggaattttgaagaagttgttgataaaggtgcttctgctcaatcttttattgaacgtatgactaattttgataaaaatttacctaatgaaaaagttttacctaaacattctttattatatgaatattttactgtttataatgaattaactaaagttaaatatgttactgaaggtatgcgtaaacctgcttttttatctggtgaacaaaaaaaagctattgttgatttattatttaaaactaatcgtaaagttactgttaaacaattaaaagaagattattttaaaaaaattgaatgttttgattctgttgaaatttctggtgttgaagatcgttttaatgcttctttaggtacttatcatgatttattaaaaattattaaagataaagattttttagataatgaagaaaatgaagatattttagaagatattgttttaactttaactttatttgaagatcgtgaaatgattgaagaacgtttaaaaacttatgctcatttatttgatgataaagttatgaaacaattaaaacgtcgtcgttatactggttggggtcgtttatctcgtaaattaattaatggtattcgtgataaacaatctggtaaaactattttagattttttaaaatctgatggttttgctaatcgtaattttatgcaattaattcatgatgattctttaacttttaaagaagatattcaaaaagctcaagtttctggtcaaggtgattctttacatgaacatattgctaatttagctggttctcctgctattaaaaaaggtattttacaaactgttaaagttgttgatgaattagttaaagttatgggtcgtcataaacctgaaaatattgttattgaaatggctcgtgaaaatcaaactactcaaaaaggtcaaaaaaattctcgtgaacgtatgaaacgtattgaagaaggtattaaagaattaggttctcaaattttaaaagaacatcctgttgaaaatactcaattacaaaatgaaaaattatatttatattatttacaaaatggtcgtgatatgtatgttgatcaagaattagatattaatcgtttatctgattatgatgttgatcatattgttcctcaatcttttttaaaagatgattctattgataataaagttttaactcgttctgataaaaatcgtggtaaatctgataatgttccttctgaagaagttgttaaaaaaatgaaaaattattggcgtcaattattaaatgctaaattaattactcaacgtaaatttgataatttaactaaagctgaacgtggtggtttatctgaattagataaagctggttttattaaacgtcaattagttgaaactcgtcaaattactaaacatgttgctcaaattttagattctcgtatgaatactaaatatgatgaaaatgataaattaattcgtgaagttaaagttattactttaaaatctaaattagtttctgattttcgtaaagattttcaattttataaagttcgtgaaattaataattatcatcatgctcatgatgcttatttaaatgctgttgttggtactgctttaattaaaaaatatcctaaattagaatctgaatttgtttatggtgattataaagtttatgatgttcgtaaaatgattgctaaatctgaacaagaaattggtaaagctactgctaaatattttttttattctaatattatgaatttttttaaaactgaaattactttagctaatggtgaaattcgtaaacgtcctttaattgaaactaatggtgaaactggtgaaattgtttgggataaaggtcgtgattttgctactgttcgtaaagttttatctatgcctcaagttaatattgttaaaaaaactgaagttcaaactggtggtttttctaaagaatctattttacctaaacgtaattctgataaattaattgctcgtaaaaaagattgggatcctaaaaaatatggtggttttgattctcctactgttgcttattctgttttagttgttgctaaagttgaaaaaggtaaatctaaaaaattaaaatctgttaaagaattattaggtattactattatggaacgttcttcttttgaaaaaaatcctattgattttttagaagctaaaggttataaagaagttaaaaaagatttaattattaaattacctaaatattctttatttgaattagaaaatggtcgtaaacgtatgttagcttctgctggtgaattacaaaaaggtaatgaattagctttaccttctaaatatgttaattttttatatttagcttctcattatgaaaaattaaaaggttctcctgaagataatgaacaaaaacaattatttgttgaacaacataaacattatttagatgaaattattgaacaaatttctgaattttctaaacgtgttattttagctgatgctaatttagataaagttttatctgcttataataaacatcgtgataaacctattcgtgaacaagctgaaaatattattcatttatttactttaactaatttaggtgctcctgctgcttttaaatattttgatactactattgatcgtaaacgttatacttctactaaagaagttttagatgctactttaattcatcaatctattactggtttatatgaaactcgtattgatttatctcaattaggtggtgatggtggtggttctcctaaaaaaaaacgtaaagtt

SEQ ID NO: 144 - DNA, 4134 bp, Artificial Sequence
  Synthetic: Cas9 ORF using low G codons of Table 4 (no start or stop codons; suitable for inclusion in fusion protein coding sequence)
gacaaaaaatactccatcggcctcgacatcggcaccaactccgtcggctgggccgtcatcaccgacgaatacaaagtcccctccaaaaaattcaaagtcctcggcaacaccgacagacactccatcaaaaaaaacctcatcggcgccctcctcttcgactccggcgaaaccgccgaagccaccagactcaaaagaaccgccagaagaagatacaccagaagaaaaaacagaatctgctacctccaagaaatcttctccaacgaaatggccaaagtcgacgactccttcttccacagactcgaagaatccttcctcgtcgaagaagacaaaaaacacgaaagacaccccatcttcggcaacatcgtcgacgaagtcgcctaccacgaaaaataccccaccatctaccacctcagaaaaaaactcgtcgactccaccgacaaagccgacctcagactcatctacctcgccctcgcccacatgatcaaattcagaggccacttcctcatcgaaggcgacctcaaccccgacaactccgacgtcgacaaactcttcatccaactcgtccaaacctacaaccaactcttcgaagaaaaccccatcaacgcctccggcgtcgacgccaaagccatcctctccgccagactctccaaatccagaagactcgaaaacctcatcgcccaactccccggcgaaaaaaaaaacggcctcttcggcaacctcatcgccctctccctcggcctcacccccaacttcaaatccaacttcgacctcgccgaagacgccaaactccaactctccaaagacacctacgacgacgacctcgacaacctcctcgcccaaatcggcgaccaatacgccgacctcttcctcgccgccaaaaacctctccgacgccatcctcctctccgacatcctcagagtcaacaccgaaatcaccaaagcccccctctccgcctccatgatcaaaagatacgacgaacaccaccaagacctcaccctcctcaaagccctcgtcagacaacaactccccgaaaaatacaaagaaatcttcttcgaccaatccaaaaacggctacgccggctacatcgacggcggcgcctcccaagaagaattctacaaattcatcaaacccatcctcgaaaaaatggacggcaccgaagaactcctcgtcaaactcaacagagaagacctcctcagaaaacaaagaaccttcgacaacggctccatcccccaccaaatccacctcggcgaactccacgccatcctcagaagacaagaagacttctaccccttcctcaaagacaacagagaaaaaatcgaaaaaatcctcaccttcagaatcccctactacgtcggccccctcgccagaggcaactccagattcgcctggatgaccagaaaatccgaagaaaccatcaccccctggaacttcgaagaagtcgtcgacaaaggcgcctccgcccaatccttcatcgaaagaatgaccaacttcgacaaaaacctccccaacgaaaaagtcctccccaaacactccctcctctacgaatacttcaccgtctacaacgaactcaccaaagtcaaatacgtcaccgaaggcatgagaaaacccgccttcctctccggcgaacaaaaaaaagccatcgtcgacctcctcttcaaaaccaacagaaaagtcaccgtcaaacaactcaaagaagactacttcaaaaaaatcgaatgcttcgactccgtcgaaatctccggcgtcgaagacagattcaacgcctccctcggcacctaccacgacctcctcaaaatcatcaaagacaaagacttcctcgacaacgaagaaaacgaagacatcctcgaagacatcgtcctcaccctcaccctcttcgaagacagagaaatgatcgaagaaagactcaaaacctacgcccacctcttcgacgacaaagtcatgaaacaactcaaaagaagaagatacaccggctggggcagactctccagaaaactcatcaacggcatcagagacaaacaatccggcaaaaccatcctcgacttcctcaaatccgacggcttcgccaacagaaacttcatgcaactcatccacgacgactccctcaccttcaaagaagacatccaaaaagcccaagtctccggccaaggcgactccctccacgaacacatcgccaacctcgccggctcccccgccatcaaaaaaggcatcctccaaaccgtcaaagtcgtcgacgaactcgtcaaagtcatgggcagacacaaacccgaaaacatcgtcatcgaaatggccagagaaaaccaaaccacccaaaaaggccaaaaaaactccagagaaagaatgaaaagaatcgaagaaggcatcaaagaactcggctcccaaatcctcaaagaacaccccgtcgaaaacacccaactccaaaacgaaaaactctacctctactacctccaaaacggcagagacatgtacgtcgaccaagaactcgacatcaacagactctccgactacgacgtcgaccacatcgtcccccaatccttcctcaaagacgactccatcgacaacaaagtcctcaccagatccgacaaaaacagaggcaaatccgacaacgtcccctccgaagaagtcgtcaaaaaaatgaaaaactactggagacaactcctcaacgccaaactcatcacccaaagaaaattcgacaacctcaccaaagccgaaagaggcggcctctccgaactcgacaaagccggcttcatcaaaagacaactcgtcgaaaccagacaaatcaccaaacacgtcgcccaaatcctcgactccagaatgaacaccaaatacgacgaaaacgacaaactcatcagagaagtcaaagtcatcaccctcaaatccaaactcgtctccgacttcagaaaagacttccaattctacaaagtcagagaaatcaacaactaccaccacgcccacgacgcctacctcaacgccgtcgtcggcaccgccctcatcaaaaaataccccaaactcgaatccgaattcgtctacggcgactacaaagtctacgacgtcagaaaaatgatcgccaaatccgaacaagaaatcggcaaagccaccgccaaatacttcttctactccaacatcatgaacttcttcaaaaccgaaatcaccctcgccaacggcgaaatcagaaaaagacccctcatcgaaaccaacggcgaaaccggcgaaatcgtctgggacaaaggcagagacttcgccaccgtcagaaaagtcctctccatgccccaagtcaacatcgtcaaaaaaaccgaagtccaaaccggcggcttctccaaagaatccatcctccccaaaagaaactccgacaaactcatcgccagaaaaaaagactgggaccccaaaaaatacggcggcttcgactcccccaccgtcgcctactccgtcctcgtcgtcgccaaagtcgaaaaaggcaaatccaaaaaactcaaatccgtcaaagaactcctcggcatcaccatcatggaaagatcctccttcgaaaaaaaccccatcgacttcctcgaagccaaaggctacaaagaagtcaaaaaagacctcatcatcaaactccccaaatactccctcttcgaactcgaaaacggcagaaaaagaatgctcgcctccgccggcgaactccaaaaaggcaacgaactcgccctcccctccaaatacgtcaacttcctctacctcgcctcccactacgaaaaactcaaaggctcccccgaagacaacgaacaaaaacaactcttcgtcgaacaacacaaacactacctcgacgaaatcatcgaacaaatctccgaattctccaaaagagtcatcctcgccgacgccaacctcgacaaagtcctctccgcctacaacaaacacagagacaaacccatcagagaacaagccgaaaacatcatccacctcttcaccctcaccaacctcggcgcccccgccgccttcaaatacttcgacaccaccatcgacagaaaaagatacacctccaccaaagaagtcctcgacgccaccctcatccaccaatccatcaccggcctctacgaaaccagaatcgacctctcccaactcggcggcgacggcggcggctcccccaaaaaaaaaagaaaagtc

SEQ ID NO: 145 - DNA, 4134 bp, Artificial Sequence
  Synthetic: Cas9 ORF using low C codons of Table 4 (no start or stop codons; suitable for inclusion in fusion protein coding sequence)
gataagaagtatagtattggattggatattggaacaaatagtgtgggatgggctgtgattacagatgagtataaggtgcctagtaagaagtttaaggtgttgggaaatacagatagacatagtattaagaagaatttgattggagctttgttgtttgatagtggagagacagctgaggctacaagattgaagagaacagctagaagaagatatacaagaagaaagaatagaatttgttatttgcaggagatttttagtaatgagatggctaaggtggatgatagtttttttcatagattggaggagagttttttggtggaggaggataagaagcatgagagacatcctatttttggaaatattgtggatgaggtggcttatcatgagaagtatcctacaatttatcatttgagaaagaagttggtggatagtacagataaggctgatttgagattgatttatttggctttggctcatatgattaagtttagaggacattttttgattgagggagatttgaatcctgataatagtgatgtggataagttgtttattcagttggtgcagacatataatcagttgtttgaggagaatcctattaatgctagtggagtggatgctaaggctattttgagtgctagattgagtaagagtagaagattggagaatttgattgctcagttgcctggagagaagaagaatggattgtttggaaatttgattgctttgagtttgggattgacacctaattttaagagtaattttgatttggctgaggatgctaagttgcagttgagtaaggatacatatgatgatgatttggataatttgttggctcagattggagatcagtatgctgatttgtttttggctgctaagaatttgagtgatgctattttgttgagtgatattttgagagtgaatacagagattacaaaggctcctttgagtgctagtatgattaagagatatgatgagcatcatcaggatttgacattgttgaaggctttggtgagacagcagttgcctgagaagtataaggagattttttttgatcagagtaagaatggatatgctggatatattgatggaggagctagtcaggaggagttttataagtttattaagcctattttggagaagatggatggaacagaggagttgttggtgaagttgaatagagaggatttgttgagaaagcagagaacatttgataatggaagtattcctcatcagattcatttgggagagttgcatgctattttgagaagacaggaggatttttatccttttttgaaggataatagagagaagattgagaagattttgacatttagaattccttattatgtgggacctttggctagaggaaatagtagatttgcttggatgacaagaaagagtgaggagacaattacaccttggaattttgaggaggtggtggataagggagctagtgctcagagttttattgagagaatgacaaattttgataagaatttgcctaatgagaaggtgttgcctaagcatagtttgttgtatgagtattttacagtgtataatgagttgacaaaggtgaagtatgtgacagagggaatgagaaagcctgcttttttgagtggagagcagaagaaggctattgtggatttgttgtttaagacaaatagaaaggtgacagtgaagcagttgaaggaggattattttaagaagattgagtgttttgatagtgtggagattagtggagtggaggatagatttaatgctagtttgggaacatatcatgatttgttgaagattattaaggataaggattttttggataatgaggagaatgaggatattttggaggatattgtgttgacattgacattgtttgaggatagagagatgattgaggagagattgaagacatatgctcatttgtttgatgataaggtgatgaagcagttgaagagaagaagatatacaggatggggaagattgagtagaaagttgattaatggaattagagataagcagagtggaaagacaattttggattttttgaagagtgatggatttgctaatagaaattttatgcagttgattcatgatgatagtttgacatttaaggaggatattcagaaggctcaggtgagtggacagggagatagtttgcatgagcatattgctaatttggctggaagtcctgctattaagaagggaattttgcagacagtgaaggtggtggatgagttggtgaaggtgatgggaagacataagcctgagaatattgtgattgagatggctagagagaatcagacaacacagaagggacagaagaatagtagagagagaatgaagagaattgaggagggaattaaggagttgggaagtcagattttgaaggagcatcctgtggagaatacacagttgcagaatgagaagttgtatttgtattatttgcagaatggaagagatatgtatgtggatcaggagttggatattaatagattgagtgattatgatgtggatcatattgtgcctcagagttttttgaaggatgatagtattgataataaggtgttgacaagaagtgataagaatagaggaaagagtgataatgtgcctagtgaggaggtggtgaagaagatgaagaattattggagacagttgttgaatgctaagttgattacacagagaaagtttgataatttgacaaaggctgagagaggaggattgagtgagttggataaggctggatttattaagagacagttggtggagacaagacagattacaaagcatgtggctcagattttggatagtagaatgaatacaaagtatgatgagaatgataagttgattagagaggtgaaggtgattacattgaagagtaagttggtgagtgattttagaaaggattttcagttttataaggtgagagagattaataattatcatcatgctcatgatgcttatttgaatgctgtggtgggaacagctttgattaagaagtatcctaagttggagagtgagtttgtgtatggagattataaggtgtatgatgtgagaaagatgattgctaagagtgagcaggagattggaaaggctacagctaagtattttttttatagtaatattatgaatttttttaagacagagattacattggctaatggagagattagaaagagacctttgattgagacaaatggagagacaggagagattgtgtgggataagggaagagattttgctacagtgagaaaggtgttgagtatgcctcaggtgaatattgtgaagaagacagaggtgcagacaggaggatttagtaaggagagtattttgcctaagagaaatagtgataagttgattgctagaaagaaggattgggatcctaagaagtatggaggatttgatagtcctacagtggcttatagtgtgttggtggtggctaaggtggagaagggaaagagtaagaagttgaagagtgtgaaggagttgttgggaattacaattatggagagaagtagttttgagaagaatcctattgattttttggaggctaagggatataaggaggtgaagaaggatttgattattaagttgcctaagtatagtttgtttgagttggagaatggaagaaagagaatgttggctagtgctggagagttgcagaagggaaatgagttggctttgcctagtaagtatgtgaattttttgtatttggctagtcattatgagaagttgaagggaagtcctgaggataatgagcagaagcagttgtttgtggagcagcataagcattatttggatgagattattgagcagattagtgagtttagtaagagagtgattttggctgatgctaatttggataaggtgttgagtgcttataataagcatagagataagcctattagagagcaggctgagaatattattcatttgtttacattgacaaatttgggagctcctgctgcttttaagtattttgatacaacaattgatagaaagagatatacaagtacaaaggaggtgttggatgctacattgattcatcagagtattacaggattgtatgagacaagaattgatttgagtcagttgggaggagatggaggaggaagtcctaagaagaagagaaaggtg

SEQ ID NO: 146 - DNA, 4134 bp, Artificial Sequence
  Synthetic: Cas9 ORF using low A codons of Table 4 (no start or stop codons; suitable for inclusion in fusion protein coding sequence)
gacaagaagtactccatcggcctggacatcggcaccaactccgtgggctgggccgtgatcaccgacgagtacaaggtgccctccaagaagttcaaggtgctgggcaacaccgaccggcactccatcaagaagaacctgatcggcgccctgctgttcgactccggcgagaccgccgaggccacccggctgaagcggaccgcccggcggcggtacacccggcggaagaaccggatctgctacctgcaggagatcttctccaacgagatggccaaggtggacgactccttcttccaccggctggaggagtccttcctggtggaggaggacaagaagcacgagcggcaccccatcttcggcaacatcgtggacgaggtggcctaccacgagaagtaccccaccatctaccacctgcggaagaagctggtggactccaccgacaaggccgacctgcggctgatctacctggccctggcccacatgatcaagttccggggccacttcctgatcgagggcgacctgaaccccgacaactccgacgtggacaagctgttcatccagctggtgcagacctacaaccagctgttcgaggagaaccccatcaacgcctccggcgtggacgccaaggccatcctgtccgcccggctgtccaagtcccggcggctggagaacctgatcgcccagctgcccggcgagaagaagaacggcctgttcggcaacctgatcgccctgtccctgggcctgacccccaacttcaagtccaacttcgacctggccgaggacgccaagctgcagctgtccaaggacacctacgacgacgacctggacaacctgctggcccagatcggcgaccagtacgccgacctgttcctggccgccaagaacctgtccgacgccatcctgctgtccgacatcctgcgggtgaacaccgagatcaccaaggcccccctgtccgcctccatgatcaagcggtacgacgagcaccaccaggacctgaccctgctgaaggccctggtgcggcagcagctgcccgagaagtacaaggagatcttcttcgaccagtccaagaacggctacgccggctacatcgacggcggcgcctcccaggaggagttctacaagttcatcaagcccatcctggagaagatggacggcaccgaggagctgctggtgaagctgaaccgggaggacctgctgcggaagcagcggaccttcgacaacggctccatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaactcccggttcgcctggatgacccggaagtccgaggagaccatcaccccctggaacttcgaggaggtggtggacaagggcgcctccgcccagtccttcatcgagcggatgaccaacttcgacaagaacctgcccaacgagaaggtgctgcccaagcactccctgctgtacgagtacttcaccgtgtacaacgagctgaccaaggtgaagtacgtgaccgagggcatgcggaagcccgccttcctgtccggcgagcagaagaaggccatcgtggacctgctgttcaagaccaaccggaaggtgaccgtgaagcagctgaaggaggactacttcaagaagatcgagtgcttcgactccgtggagatctccggcgtggaggaccggttcaacgcctccctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgtcccggaagctgatcaacggcatccgggacaagcagtccggcaagaccatcctggacttcctgaagtccgacggcttcgccaaccggaacttcatgcagctgatccacgacgactccctgaccttcaaggaggacatccagaaggcccaggtgtccggccagggcgactccctgcacgagcacatcgccaacctggccggctcccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaactcccgggagcggatgaagcggatcgaggagggcatcaaggagctgggctcccagatcctgaaggagcaccccgtggagaacacccagctgcagaacgagaagctgtacctgtactacctgcagaacggccgggacatgtacgtggaccaggagctggacatcaaccggctgtccgactacgacgtggaccacatcgtgccccagtccttcctgaaggacgactccatcgacaacaaggtgctgacccggtccgacaagaaccggggcaagtccgacaacgtgccctccgaggaggtggtgaagaagatgaagaactactggcggcagctgctgaacgccaagctgatcacccagcggaagttcgacaacctgaccaaggccgagcggggcggcctgtccgagctggacaaggccggcttcatcaagcggcagctggtggagacccggcagatcaccaagcacgtggcccagatcctggactcccggatgaacaccaagtacgacgagaacgacaagctgatccgggaggtgaaggtgatcaccctgaagtccaagctggtgtccgacttccggaaggacttccagttctacaaggtgcgggagatcaacaactaccaccacgcccacgacgcctacctgaacgccgtggtgggcaccgccctgatcaagaagtaccccaagctggagtccgagttcgtgtacggcgactacaaggtgtacgacgtgcggaagatgatcgccaagtccgagcaggagatcggcaaggccaccgccaagtacttcttctactccaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgtccatgccccaggtgaacatcgtgaagaagaccgaggtgcagaccggcggcttctccaaggagtccatcctgcccaagcggaactccgacaagctgatcgcccggaagaaggactgggaccccaagaagtacggcggcttcgactcccccaccgtggcctactccgtgctggtggtggccaaggtggagaagggcaagtccaagaagctgaagtccgtgaaggagctgctgggcatcaccatcatggagcggtcctccttcgagaagaaccccatcgacttcctggaggccaagggctacaaggaggtgaagaaggacctgatcatcaagctgcccaagtactccctgttcgagctggagaacggccggaagcggatgctggcctccgccggcgagctgcagaagggcaacgagctggccctgccctccaagtacgtgaacttcctgtacctggcctcccactacgagaagctgaagggctcccccgaggacaacgagcagaagcagctgttcgtggagcagcacaagcactacctggacgagatcatcgagcagatctccgagttctccaagcgggtgatcctggccgacgccaacctggacaaggtgctgtccgcctacaacaagcaccgggacaagcccatccgggagcaggccgagaacatcatccacctgttcaccctgaccaacctgggcgcccccgccgccttcaagtacttcgacaccaccatcgaccggaagcggtacacctccaccaaggaggtgctggacgccaccctgatccaccagtccatcaccggcctgtacgagacccggatcgacctgtcccagctgggcggcgacggcggcggctcccccaagaagaagcggaaggtg

SEQ ID NO: 147 - DNA, 4134 bp, Artificial Sequence
  Synthetic: Cas9 ORF using low A/U codons of Table 4 (no start or stop codons; suitable for inclusion in fusion protein coding sequence)
gacaagaagtacagcatcggcctggacatcggcaccaacagcgtgggctgggccgtgatcaccgacgagtacaaggtgcccagcaagaagttcaaggtgctgggcaacaccgaccggcacagcatcaagaagaacctgatcggcgccctgctgttcgacagcggcgagaccgccgaggccacccggctgaagcggaccgcccggcggcggtacacccggcggaagaaccggatctgctacctgcaggagatcttcagcaacgagatggccaaggtggacgacagcttcttccaccggctggaggagagcttcctggtggaggaggacaagaagcacgagcggcaccccatcttcggcaacatcgtggacgaggtggcctaccacgagaagtaccccaccatctaccacctgcggaagaagctggtggacagcaccgacaaggccgacctgcggctgatctacctggccctggcccacatgatcaagttccggggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccggctgagcaagagccggcggctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgggtgaacaccgagatcaccaaggcccccctgagcgccagcatgatcaagcggtacgacgagcaccaccaggacctgaccctgctgaaggccctggtgcggcagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgggaggacctgctgcggaagcagcggaccttcgacaacggcagcatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaacagccggttcgcctggatgacccggaagagcgaggagaccatcaccccctggaacttcgaggaggtggtggacaagggcgccagcgcccagagcttcatcgagcggatgaccaacttcgacaagaacctgcccaacgagaaggtgctgcccaagcacagcctgctgtacgagtacttcaccgtgtacaacgagctgaccaaggtgaagtacgtgaccgagggcatgcggaagcccgccttcctgagcggcgagcagaagaaggccatcgtggacctgctgttcaagaccaaccggaaggtgaccgtgaagcagctgaaggaggactacttcaagaagatcgagtgcttcgacagcgtggagatcagcggcgtggaggaccggttcaacgccagcctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgagccggaagctgatcaacggcatccgggacaagcagagcggcaagaccatcctggacttcctgaagagcgacggcttcgccaaccggaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaacagccgggagcggatgaagcggatcgaggagggcatcaaggagctgggcagccagatcctgaaggagcaccccgtggagaacacccagctgcagaacgagaagctgtacctgtactacctgcagaacggccgggacatgtacgtggaccaggagctggacatcaaccggctgagcgactacgacgtggaccacatcgtgccccagagcttcctgaaggacgacagcatcgacaacaaggtgctgacccggagcgacaagaaccggggcaagagcgacaacgtgcccagcgaggaggtggtgaagaagatgaagaactactggcggcagctgctgaacgccaagctgatcacccagcggaagttcgacaacctgaccaaggccgagcggggcggcctgagcgagctggacaaggccggcttcatcaagcggcagctggtggagacccggcagatcaccaagcacgtggcccagatcctggacagccggatgaacaccaagtacgacgagaacgacaagctgatccgggaggtgaaggtgatcaccctgaagagcaagctggtgagcgacttccggaaggacttccagttctacaaggtgcgggagatcaacaactaccaccacgcccacgacgcctacctgaacgccgtggtgggcaccgccctgatcaagaagtaccccaagctggagagcgagttcgtgtacggcgactacaaggtgtacgacgtgcggaagatgatcgccaagagcgagcaggagatcggcaaggccaccgccaagtacttcttctacagcaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgagcatgccccaggtgaacatcgtgaagaagaccgaggtgcagaccggcggcttcagcaaggagagcatcctgcccaagcggaacagcgacaagctgatcgcccggaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcggagcagcttcgagaagaaccccatcgacttcctggaggccaagggctacaaggaggtgaagaaggacctgatcatcaagctgcccaagtacagcctgttcgagctggagaacggccggaagcggatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgggtgatcctggccgacgccaacctggacaaggtgctgagcgcctacaacaagcaccgggacaagcccatccgggagcaggccgagaacatcatccacctgttcaccctgaccaacctgggcgcccccgccgccttcaagtacttcgacaccaccatcgaccggaagcggtacaccagcaccaaggaggtgctggacgccaccctgatccaccagagcatcaccggcctgtacgagacccggatcgacctgagccagctgggcggcgacggcggcggcagccccaagaagaagcggaaggtg

SEQ ID NO: 148 - DNA, 4173 bp, Artificial Sequence
  Synthetic: Cas9 ORF using low A codons of Table 4, with two C-terminal NLS sequences (no start or stop codons; suitable for inclusion in fusion protein coding sequence)
gacaagaagtactccatcggcctggacatcggcaccaactccgtgggctgggccgtgatcaccgacgagtacaaggtgccctccaagaagttcaaggtgctgggcaacaccgaccggcactccatcaagaagaacctgatcggcgccctgctgttcgactccggcgagaccgccgaggccacccggctgaagcggaccgcccggcggcggtacacccggcggaagaaccggatctgctacctgcaggagatcttctccaacgagatggccaaggtggacgactccttcttccaccggctggaggagtccttcctggtggaggaggacaagaagcacgagcggcaccccatcttcggcaacatcgtggacgaggtggcctaccacgagaagtaccccaccatctaccacctgcggaagaagctggtggactccaccgacaaggccgacctgcggctgatctacctggccctggcccacatgatcaagttccggggccacttcctgatcgagggcgacctgaaccccgacaactccgacgtggacaagctgttcatccagctggtgcagacctacaaccagctgttcgaggagaaccccatcaacgcctccggcgtggacgccaaggccatcctgtccgcccggctgtccaagtcccggcggctggagaacctgatcgcccagctgcccggcgagaagaagaacggcctgttcggcaacctgatcgccctgtccctgggcctgacccccaacttcaagtccaacttcgacctggccgaggacgccaagctgcagctgtccaaggacacctacgacgacgacctggacaacctgctggcccagatcggcgaccagtacgccgacctgttcctggccgccaagaacctgtccgacgccatcctgctgtccgacatcctgcgggtgaacaccgagatcaccaaggcccccctgtccgcctccatgatcaagcggtacgacgagcaccaccaggacctgaccctgctgaaggccctggtgcggcagcagctgcccgagaagtacaaggagatcttcttcgaccagtccaagaacggctacgccggctacatcgacggcggcgcctcccaggaggagttctacaagttcatcaagcccatcctggagaagatggacggcaccgaggagctgctggtgaagctgaaccgggaggacctgctgcggaagcagcggaccttcgacaacggctccatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaactcccggttcgcctggatgacccggaagtccgaggagaccatcaccccctggaacttcgaggaggtggtggacaagggcgcctccgcccagtccttcatcgagcggatgaccaacttcgacaagaacctgcccaacgagaaggtgctgcccaagcactccctgctgtacgagtacttcaccgtgtacaacgagctgaccaaggtgaagtacgtgaccgagggcatgcggaagcccgccttcctgtccggcgagcagaagaaggccatcgtggacctgctgttcaagaccaaccggaaggtgaccgtgaagcagctgaaggaggactacttcaagaagatcgagtgcttcgactccgtggagatctccggcgtggaggaccggttcaacgcctccctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgtcccggaagctgatcaacggcatccgggacaagcagtccggcaagaccatcctggacttcctgaagtccgacggcttcgccaaccggaacttcatgcagctgatccacgacgactccctgaccttcaaggaggacatccagaaggcccaggtgtccggccagggcgactccctgcacgagcacatcgccaacctggccggctcccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaactcccgggagcggatgaagcggatcgaggagggcatcaaggagctgggctcccagatcctgaaggagcaccccgtggagaacacccagctgcagaacgagaagctgtacctgtactacctgcagaacggccgggacatgtacgtggaccaggagctggacatcaaccggctgtccgactacgacgtggaccacatcgtgccccagtccttcctgaaggacgactccatcgacaacaaggtgctgacccggtccgacaagaaccggggcaagtccgacaacgtgccctccgaggaggtggtgaagaagatgaagaactactggcggcagctgctgaacgccaagctgatcacccagcggaagttcgacaacctgaccaaggccgagcggggcggcctgtccgagctggacaaggccggcttcatcaagcggcagctggtggagacccggcagatcaccaagcacgtggcccagatcctggactcccggatgaacaccaagtacgacgagaacgacaagctgatccgggaggtgaaggtgatcaccctgaagtccaagctggtgtccgacttccggaaggacttccagttctacaaggtgcgggagatcaacaactaccaccacgcccacgacgcctacctgaacgccgtggtgggcaccgccctgatcaagaagtaccccaagctggagtccgagttcgtgtacggcgactacaaggtgtacgacgtgcggaagatgatcgccaagtccgagcaggagatcggcaaggccaccgccaagtacttcttctactccaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgtccatgccccaggtgaacatcgtgaagaagaccgaggtgcagaccggcggcttctccaaggagtccatcctgcccaagcggaactccgacaagctgatcgcccggaagaaggactgggaccccaagaagtacggcggcttcgactcccccaccgtggcctactccgtgctggtggtggccaaggtggagaagggcaagtccaagaagctgaagtccgtgaaggagctgctgggcatcaccatcatggagcggtcctccttcgagaagaaccccatcgacttcctggaggccaagggctacaaggaggtgaagaaggacctgatcatcaagctgcccaagtactccctgttcgagctggagaacggccggaagcggatgctggcctccgccggcgagctgcagaagggcaacgagctggccctgccctccaagtacgtgaacttcctgtacctggcctcccactacgagaagctgaagggctcccccgaggacaacgagcagaagcagctgttcgtggagcagcacaagcactacctggacgagatcatcgagcagatctccgagttctccaagcgggtgatcctggccgacgccaacctggacaaggtgctgtccgcctacaacaagcaccgggacaagcccatccgggagcaggccgagaacatcatccacctgttcaccctgaccaacctgggcgcccccgccgccttcaagtacttcgacaccaccatcgaccggaagcggtacacctccaccaaggaggtgctggacgccaccctgatccaccagtccatcaccggcctgtacgagacccggatcgacctgtcccagctgggcggcgacggctccggctcccccaagaagaagcggaaggtggacggctcccccaagaagaagcggaaggtggactccggc

SEQ ID NO: 149 - DNA, 4134 bp, Artificial Sequence
  Synthetic: Cas9 nickase ORF using low A codons of Table 4 (no start or stop codons; suitable for inclusion in fusion protein coding sequence)
gacaagaagtactccatcggcctggccatcggcaccaactccgtgggctgggccgtgatcaccgacgagtacaaggtgccctccaagaagttcaaggtgctgggcaacaccgaccggcactccatcaagaagaacctgatcggcgccctgctgttcgactccggcgagaccgccgaggccacccggctgaagcggaccgcccggcggcggtacacccggcggaagaaccggatctgctacctgcaggagatcttctccaacgagatggccaaggtggacgactccttcttccaccggctggaggagtccttcctggtggaggaggacaagaagcacgagcggcaccccatcttcggcaacatcgtggacgaggtggcctaccacgagaagtaccccaccatctaccacctgcggaagaagctggtggactccaccgacaaggccgacctgcggctgatctacctggccctggcccacatgatcaagttccggggccacttcctgatcgagggcgacctgaaccccgacaactccgacgtggacaagctgttcatccagctggtgcagacctacaaccagctgttcgaggagaaccccatcaacgcctccggcgtggacgccaaggccatcctgtccgcccggctgtccaagtcccggcggctggagaacctgatcgcccagctgcccggcgagaagaagaacggcctgttcggcaacctgatcgccctgtccctgggcctgacccccaacttcaagtccaacttcgacctggccgaggacgccaagctgcagctgtccaaggacacctacgacgacgacctggacaacctgctggcccagatcggcgaccagtacgccgacctgttcctggccgccaagaacctgtccgacgccatcctgctgtccgacatcctgcgggtgaacaccgagatcaccaaggcccccctgtccgcctccatgatcaagcggtacgacgagcaccaccaggacctgaccctgctgaaggccctggtgcggcagcagctgcccgagaagtacaaggagatcttcttcgaccagtccaagaacggctacgccggctacatcgacggcggcgcctcccaggaggagttctacaagttcatcaagcccatcctggagaagatggacggcaccgaggagctgctggtgaagctgaaccgggaggacctgctgcggaagcagcggaccttcgacaacggctccatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaactcccggttcgcctggatgacccggaagtccgaggagaccatcaccccctggaacttcgaggaggtggtggacaagggcgcctccgcccagtccttcatcgagcggatgaccaacttcgacaagaacctgcccaacgagaaggtgctgcccaagcactccctgctgtacgagtacttcaccgtgtacaacgagctgaccaaggtgaagtacgtgaccgagggcatgcggaagcccgccttcctgtccggcgagcagaagaaggccatcgtggacctgctgttcaagaccaaccggaaggtgaccgtgaagcagctgaaggaggactacttcaagaagatcgagtgcttcgactccgtggagatctccggcgtggaggaccggttcaacgcctccctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgtcccggaagctgatcaacggcatccgggacaagcagtccggcaagaccatcctggacttcctgaagtccgacggcttcgccaaccggaacttcatgcagctgatccacgacgactccctgaccttcaaggaggacatccagaaggcccaggtgtccggccagggcgactccctgcacgagcacatcgccaacctggccggctcccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaactcccgggagcggatgaagcggatcgaggagggcatcaaggagctgggctcccagatcctgaaggagcaccccgtggagaacacccagctgcagaacgagaagctgtacctgtactacctgcagaacggccgggacatgtacgtggaccaggagctggacatcaaccggctgtccgactacgacgtggaccacatcgtgccccagtccttcctgaaggacgactccatcgacaacaaggtgctgacccggtccgacaagaaccggggcaagtccgacaacgtgccctccgaggaggtggtgaagaagatgaagaactactggcggcagctgctgaacgccaagctgatcacccagcggaagttcgacaacctgaccaaggccgagcggggcggcctgtccgagctggacaaggccggcttcatcaagcggcagctggtggagacccggcagatcaccaagcacgtggcccagatcctggactcccggatgaacaccaagtacgacgagaacgacaagctgatccgggaggtgaaggtgatcaccctgaagtccaagctggtgtccgacttccggaaggacttccagttctacaaggtgcgggagatcaacaactaccaccacgcccacgacgcctacctgaacgccgtggtgggcaccgccctgatcaagaagtaccccaagctggagtccgagttcgtgtacggcgactacaaggtgtacgacgtgcggaagatgatcgccaagtccgagcaggagatcggcaaggccaccgccaagtacttcttctactccaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgtccatgccccaggtgaacatcgtgaagaagaccgaggtgcagaccggcggcttctccaaggagtccatcctgcccaagcggaactccgacaagctgatcgcccggaagaaggactgggaccccaagaagtacggcggcttcgactcccccaccgtggcctactccgtgctggtggtggccaaggtggagaagggcaagtccaagaagctgaagtccgtgaaggagctgctgggcatcaccatcatggagcggtcctccttcgagaagaaccccatcgacttcctggaggccaagggctacaaggaggtgaagaaggacctgatcatcaagctgcccaagtactccctgttcgagctggagaacggccggaagcggatgctggcctccgccggcgagctgcagaagggcaacgagctggccctgccctccaagtacgtgaacttcctgtacctggcctcccactacgagaagctgaagggctcccccgaggacaacgagcagaagcagctgttcgtggagcagcacaagcactacctggacgagatcatcgagcagatctccgagttctccaagcgggtgatcctggccgacgccaacctggacaaggtgctgtccgcctacaacaagcaccgggacaagcccatccgggagcaggccgagaacatcatccacctgttcaccctgaccaacctgggcgcccccgccgccttcaagtacttcgacaccaccatcgaccggaagcggtacacctccaccaaggaggtgctggacgccaccctgatccaccagtccatcaccggcctgtacgagacccggatcgacctgtcccagctgggcggcgacggcggcggctcccccaagaagaagcggaaggtg

SEQ ID NO: 150 - DNA, 4101 bp, Artificial Sequence
  Synthetic: Cas9 nickase ORF using low A codons of Table 4 (no NLS and no start or stop codons; suitable for inclusion in fusion protein coding sequence)
gacaagaagtactccatcggcctggccatcggcaccaactccgtgggctgggccgtgatcaccgacgagtacaaggtgccctccaagaagttcaaggtgctgggcaacaccgaccggcactccatcaagaagaacctgatcggcgccctgctgttcgactccggcgagaccgccgaggccacccggctgaagcggaccgcccggcggcggtacacccggcggaagaaccggatctgctacctgcaggagatcttctccaacgagatggccaaggtggacgactccttcttccaccggctggaggagtccttcctggtggaggaggacaagaagcacgagcggcaccccatcttcggcaacatcgtggacgaggtggcctaccacgagaagtaccccaccatctaccacctgcggaagaagctggtggactccaccgacaaggccgacctgcggctgatctacctggccctggcccacatgatcaagttccggggccacttcctgatcgagggcgacctgaaccccgacaactccgacgtggacaagctgttcatccagctggtgcagacctacaaccagctgttcgaggagaaccccatcaacgcctccggcgtggacgccaaggccatcctgtccgcccggctgtccaagtcccggcggctggagaacctgatcgcccagctgcccggcgagaagaagaacggcctgttcggcaacctgatcgccctgtccctgggcctgacccccaacttcaagtccaacttcgacctggccgaggacgccaagctgcagctgtccaaggacacctacgacgacgacctggacaacctgctggcccagatcggcgaccagtacgccgacctgttcctggccgccaagaacctgtccgacgccatcctgctgtccgacatcctgcgggtgaacaccgagatcaccaaggcccccctgtccgcctccatgatcaagcggtacgacgagcaccaccaggacctgaccctgctgaaggccctggtgcggcagcagctgcccgagaagtacaaggagatcttcttcgaccagtccaagaacggctacgccggctacatcgacggcggcgcctcccaggaggagttctacaagttcatcaagcccatcctggagaagatggacggcaccgaggagctgctggtgaagctgaaccgggaggacctgctgcggaagcagcggaccttcgacaacggctccatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaactcccggttcgcctggatgacccggaagtccgaggagaccatcaccccctggaacttcgaggaggtggtggacaagggcgcctccgcccagtccttcatcgagcggatgaccaacttcgacaagaacctgcccaacgagaaggtgctgcccaagcactccctgctgtacgagtacttcaccgtgtacaacgagctgaccaaggtgaagtacgtgaccgagggcatgcggaagcccgccttcctgtccggcgagcagaagaaggccatcgtggacctgctgttcaagaccaaccggaaggtgaccgtgaagcagctgaaggaggactacttcaagaagatcgagtgcttcgactccgtggagatctccggcgtggaggaccggttcaacgcctccctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgtcccggaagctgatcaacggcatccgggacaagcagtccggcaagaccatcctggacttcctgaagtccgacggcttcgccaaccggaacttcatgcagctgatccacgacgactccctgaccttcaaggaggacatccagaaggcccaggtgtccggccagggcgactccctgcacgagcacatcgccaacctggccggctcccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaactcccgggagcggatgaagcggatcgaggagggcatcaaggagctgggctcccagatcctgaaggagcaccccgtggagaacacccagctgcagaacgagaagctgtacctgtactacctgcagaacggccgggacatgtacgtggaccaggagctggacatcaaccggctgtccgactacgacgtggaccacatcgtgccccagtccttcctgaaggacgactccatcgacaacaaggtgctgacccggtccgacaagaaccggggcaagtccgacaacgtgccctccgaggaggtggtgaagaagatgaagaactactggcggcagctgctgaacgccaagctgatcacccagcggaagttcgacaacctgaccaaggccgagcggggcggcctgtccgagctggacaaggccggcttcatcaagcggcagctggtggagacccggcagatcaccaagcacgtggcccagatcctggactcccggatgaacaccaagtacgacgagaacgacaagctgatccgggaggtgaaggtgatcaccctgaagtccaagctggtgtccgacttccggaaggacttccagttctacaaggtgcgggagatcaacaactaccaccacgcccacgacgcctacctgaacgccgtggtgggcaccgccctgatcaagaagtaccccaagctggagtccgagttcgtgtacggcgactacaaggtgtacgacgtgcggaagatgatcgccaagtccgagcaggagatcggcaaggccaccgccaagtacttcttctactccaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgtccatgccccaggtgaacatcgtgaagaagaccgaggtgcagaccggcggcttctccaaggagtccatcctgcccaagcggaactccgacaagctgatcgcccggaagaaggactgggaccccaagaagtacggcggcttcgactcccccaccgtggcctactccgtgctggtggtggccaaggtggagaagggcaagtccaagaagctgaagtccgtgaaggagctgctgggcatcaccatcatggagcggtcctccttcgagaagaaccccatcgacttcctggaggccaagggctacaaggaggtgaagaaggacctgatcatcaagctgcccaagtactccctgttcgagctggagaacggccggaagcggatgctggcctccgccggcgagctgcagaagggcaacgagctggccctgccctccaagtacgtgaacttcctgtacctggcctcccactacgagaagctgaagggctcccccgaggacaacgagcagaagcagctgttcgtggagcagcacaagcactacctggacgagatcatcgagcagatctccgagttctccaagcgggtgatcctggccgacgccaacctggacaaggtgctgtccgcctacaacaagcaccgggacaagcccatccgggagcaggccgagaacatcatccacctgttcaccctgaccaacctgggcgcccccgccgccttcaagtacttcgacaccaccatcgaccggaagcggtacacctccaccaaggaggtgctggacgccaccctgatccaccagtccatcaccggcctgtacgagacccggatcgacctgtcccagctgggcggcgac

SEQ ID NO: 151 - DNA, 4173 bp, Artificial Sequence
  Synthetic: Cas9 nickase ORF using low A codons of Table 4, with two C-terminal NLS sequences (no start or stop codons; suitable for inclusion in fusion protein coding sequence)
gacaagaagtactccatcggcctggccatcggcaccaactccgtgggctgggccgtgatcaccgacgagtacaaggtgccctccaagaagttcaaggtgctgggcaacaccgaccggcactccatcaagaagaacctgatcggcgccctgctgttcgactccggcgagaccgccgaggccacccggctgaagcggaccgcccggcggcggtacacccggcggaagaaccggatctgctacctgcaggagatcttctccaacgagatggccaaggtggacgactccttcttccaccggctggaggagtccttcctggtggaggaggacaagaagcacgagcggcaccccatcttcggcaacatcgtggacgaggtggcctaccacgagaagtaccccaccatctaccacctgcggaagaagctggtggactccaccgacaaggccgacctgcggctgatctacctggccctggcccacatgatcaagttccggggccacttcctgatcgagggcgacctgaaccccgacaactccgacgtggacaagctgttcatccagctggtgcagacctacaaccagctgttcgaggagaaccccatcaacgcctccggcgtggacgccaaggccatcctgtccgcccggctgtccaagtcccggcggctggagaacctgatcgcccagctgcccggcgagaagaagaacggcctgttcggcaacctgatcgccctgtccctgggcctgacccccaacttcaagtccaacttcgacctggccgaggacgccaagctgcagctgtccaaggacacctacgacgacgacctggacaacctgctggcccagatcggcgaccagtacgccgacctgttcctggccgccaagaacctgtccgacgccatcctgctgtccgacatcctgcgggtgaacaccgagatcaccaaggcccccctgtccgcctccatgatcaagcggtacgacgagcaccaccaggacctgaccctgctgaaggccctggtgcggcagcagctgcccgagaagtacaaggagatcttcttcgaccagtccaagaacggctacgccggctacatcgacggcggcgcctcccaggaggagttctacaagttcatcaagcccatcctggagaagatggacggcaccgaggagctgctggtgaagctgaaccgggaggacctgctgcggaagcagcggaccttcgacaacggctccatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaactcccggttcgcctggatgacccggaagtccgaggagaccatcaccccctggaacttcgaggaggtggtggacaagggcgcctccgcccagtccttcatcgagcggatgaccaacttcgacaagaacctgcccaacgagaaggtgctgcccaagcactccctgctgtacgagtacttcaccgtgtacaacgagctgaccaaggtgaagtacgtgaccgagggcatgcggaagcccgccttcctgtccggcgagcagaagaaggccatcgtggacctgctgttcaagaccaaccggaaggtgaccgtgaagcagctgaaggaggactacttcaagaagatcgagtgcttcgactccgtggagatctccggcgtggaggaccggttcaacgcctccctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgtcccggaagctgatcaacggcatccgggacaagcagtccggcaagaccatcctggacttcctgaagtccgacggcttcgccaaccggaacttcatgcagctgatccacgacgactccctgaccttcaaggaggacatccagaaggcccaggtgtccggccagggcgactccctgcacgagcacatcgccaacctggccggctcccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaactcccgggagcggatgaagcggatcgaggagggcatcaaggagctgggctcccagatcctgaaggagcaccccgtggagaacacccagctgcagaacgagaagctgtacctgtactacctgcagaacggccgggacatgtacgtggaccaggagctggacatcaaccggctgtccgactacgacgtggaccacatcgtgccccagtccttcctgaaggacgactccatcgacaacaaggtgctgacccggtccgacaagaaccggggcaagtccgacaacgtgccctccgaggaggtggtgaagaagatgaagaactactggcggcagctgctgaacgccaagctgatcacccagcggaagttcgacaacctgaccaaggccgagcggggcggcctgtccgagctggacaaggccggcttcatcaagcggcagctggtggagacccggcagatcaccaagcacgtggcccagatcctggactcccggatgaacaccaagtacgacgagaacgacaagctgatccgggaggtgaaggtgatcaccctgaagtccaagctggtgtccgacttccggaaggacttccagttctacaaggtgcgggagatcaacaactaccaccacgcccacgacgcctacctgaacgccgtggtgggcaccgccctgatcaagaagtaccccaagctggagtccgagttcgtgtacggcgactacaaggtgtacgacgtgcggaagatgatcgccaagtccgagcaggagatcggcaaggccaccgccaagtacttcttctactccaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgtccatgccccaggtgaacatcgtgaagaagaccgaggtgcagaccggcggcttctccaaggagtccatcctgcccaagcggaactccgacaagctgatcgcccggaagaaggactgggaccccaagaagtacggcggcttcgactcccccaccgtggcctactccgtgctggtggtggccaaggtggagaagggcaagtccaagaagctgaagtccgtgaaggagctgctgggcatcaccatcatggagcggtcctccttcgagaagaaccccatcgacttcctggaggccaagggctacaaggaggtgaagaaggacctgatcatcaagctgcccaagtactccctgttcgagctggagaacggccggaagcggatgctggcctccgccggcgagctgcagaagggcaacgagctggccctgccctccaagtacgtgaacttcctgtacctggcctcccactacgagaagctgaagggctcccccgaggacaacgagcagaagcagctgttcgtggagcagcacaagcactacctggacgagatcatcgagcagatctccgagttctccaagcgggtgatcctggccgacgccaacctggacaaggtgctgtccgcctacaacaagcaccgggacaagcccatccgggagcaggccgagaacatcatccacctgttcaccctgaccaacctgggcgcccccgccgccttcaagtacttcgacaccaccatcgaccggaagcggtacacctccaccaaggaggtgctggacgccaccctgatccaccagtccatcaccggcctgtacgagacccggatcgacctgtcccagctgggcggcgacggctccggctcccccaagaagaagcggaaggtggacggctcccccaagaagaagcggaaggtggactccggc

SEQ ID NO: 152 - DNA, 4134 bp, Artificial Sequence
  Synthetic: dCas9 ORF using low A codons of Table 4 (no start or stop codons; suitable for inclusion in fusion protein coding sequence)
gacaagaagtactccatcggcctggccatcggcaccaactccgtgggctgggccgtgatcaccgacgagtacaaggtgccctccaagaagttcaaggtgctgggcaacaccgaccggcactccatcaagaagaacctgatcggcgccctgctgttcgactccggcgagaccgccgaggccacccggctgaagcggaccgcccggcggcggtacacccggcggaagaaccggatctgctacctgcaggagatcttctccaacgagatggccaaggtggacgactccttcttccaccggctggaggagtccttcctggtggaggaggacaagaagcacgagcggcaccccatcttcggcaacatcgtggacgaggtggcctaccacgagaagtaccccaccatctaccacctgcggaagaagctggtggactccaccgacaaggccgacctgcggctgatctacctggccctggcccacatgatcaagttccggggccacttcctgatcgagggcgacctgaaccccgacaactccgacgtggacaagctgttcatccagctggtgcagacctacaaccagctgttcgaggagaaccccatcaacgcctccggcgtggacgccaaggccatcctgtccgcccggctgtccaagtcccggcggctggagaacctgatcgcccagctgcccggcgagaagaagaacggcctgttcggcaacctgatcgccctgtccctgggcctgacccccaacttcaagtccaacttcgacctggccgaggacgccaagctgcagctgtccaaggacacctacgacgacgacctggacaacctgctggcccagatcggcgaccagtacgccgacctgttcctggccgccaagaacctgtccgacgccatcctgctgtccgacatcctgcgggtgaacaccgagatcaccaaggcccccctgtccgcctccatgatcaagcggtacgacgagcaccaccaggacctgaccctgctgaaggccctggtgcggcagcagctgcccgagaagtacaaggagatcttcttcgaccagtccaagaacggctacgccggctacatcgacggcggcgcctcccaggaggagttctacaagttcatcaagcccatcctggagaagatggacggcaccgaggagctgctggtgaagctgaaccgggaggacctgctgcggaagcagcggaccttcgacaacggctccatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaactcccggttcgcctggatgacccggaagtccgaggagaccatcaccccctggaacttcgaggaggtggtggacaagggcgcctccgcccagtccttcatcgagcggatgaccaacttcgacaagaacctgcccaacgagaaggtgctgcccaagcactccctgctgtacgagtacttcaccgtgtacaacgagctgaccaaggtgaagtacgtgaccgagggcatgcggaagcccgccttcctgtccggcgagcagaagaaggccatcgtggacctgctgttcaagaccaaccggaaggtgaccgtgaagcagctgaaggaggactacttcaagaagatcgagtgcttcgactccgtggagatctccggcgtggaggaccggttcaacgcctccctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgtcccggaagctgatcaacggcatccgggacaagcagtccggcaagaccatcctggacttcctgaagtccgacggcttcgccaaccggaacttcatgcagctgatccacgacgactccctgaccttcaaggaggacatccagaaggcccaggtgtccggccagggcgactccctgcacgagcacatcgccaacctggccggctcccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaactcccgggagcggatgaagcggatcgaggagggcatcaaggagctgggctcccagatcctgaaggagcaccccgtggagaacacccagctgcagaacgagaagctgtacctgtactacctgcagaacggccgggacatgtacgtggaccaggagctggacatcaaccggctgtccgactacgacgtggacgccatcgtgccccagtccttcctgaaggacgactccatcgacaacaaggtgctgacccggtccgacaagaaccggggcaagtccgacaacgtgccctccgaggaggtggtgaagaagatgaagaactactggcggcagctgctgaacgccaagctgatcacccagcggaagttcgacaacctgaccaaggccgagcggggcggcctgtccgagctggacaaggccggcttcatcaagcggcagctggtggagacccggcagatcaccaagcacgtggcccagatcctggactcccggatgaacaccaagtacgacgagaacgacaagctgatccgggaggtgaaggtgatcaccctgaagtccaagctggtgtccgacttccggaaggacttccagttctacaaggtgcgggagatcaacaactaccaccacgcccacgacgcctacctgaacgccgtggtgggcaccgccctgatcaagaagtaccccaagctggagtccgagttcgtgtacggcgactacaaggtgtacgacgtgcggaagatgatcgccaagtccgagcaggagatcggcaaggccaccgccaagtacttcttctactccaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgtccatgccccaggtgaacatcgtgaagaagaccgaggtgcagaccggcggcttctccaaggagtccatcctgcccaagcggaactccgacaagctgatcgcccggaagaaggactgggaccccaagaagtacggcggcttcgactcccccaccgtggcctactccgtgctggtggtggccaaggtggagaagggcaagtccaagaagctgaagtccgtgaaggagctgctgggcatcaccatcatggagcggtcctccttcgagaagaaccccatcgacttcctggaggccaagggctacaaggaggtgaagaaggacctgatcatcaagctgcccaagtactccctgttcgagctggagaacggccggaagcggatgctggcctccgccggcgagctgcagaagggcaacgagctggccctgccctccaagtacgtgaacttcctgtacctggcctcccactacgagaagctgaagggctcccccgaggacaacgagcagaagcagctgttcgtggagcagcacaagcactacctggacgagatcatcgagcagatctccgagttctccaagcgggtgatcctggccgacgccaacctggacaaggtgctgtccgcctacaacaagcaccgggacaagcccatccgggagcaggccgagaacatcatccacctgttcaccctgaccaacctgggcgcccccgccgccttcaagtacttcgacaccaccatcgaccggaagcggtacacctccaccaaggaggtgctggacgccaccctgatccaccagtccatcaccggcctgtacgagacccggatcgacctgtcccagctgggcggcgacggcggcggctcccccaagaagaagcggaaggtg

SEQ ID NO: 153 - DNA, 4101 bp, Artificial Sequence
  Synthetic: dCas9 ORF using low A codons of Table 4 (no NLS and no start or stop codons; suitable for inclusion in fusion protein coding sequence)
gacaagaagtactccatcggcctggccatcggcaccaactccgtgggctgggccgtgatcaccgacgagtacaaggtgccctccaagaagttcaaggtgctgggcaacaccgaccggcactccatcaagaagaacctgatcggcgccctgctgttcgactccggcgagaccgccgaggccacccggctgaagcggaccgcccggcggcggtacacccggcggaagaaccggatctgctacctgcaggagatcttctccaacgagatggccaaggtggacgactccttcttccaccggctggaggagtccttcctggtggaggaggacaagaagcacgagcggcaccccatcttcggcaacatcgtggacgaggtggcctaccacgagaagtaccccaccatctaccacctgcggaagaagctggtggactccaccgacaaggccgacctgcggctgatctacctggccctggcccacatgatcaagttccggggccacttcctgatcgagggcgacctgaaccccgacaactccgacgtggacaagctgttcatccagctggtgcagacctacaaccagctgttcgaggagaaccccatcaacgcctccggcgtggacgccaaggccatcctgtccgcccggctgtccaagtcccggcggctggagaacctgatcgcccagctgcccggcgagaagaagaacggcctgttcggcaacctgatcgccctgtccctgggcctgacccccaacttcaagtccaacttcgacctggccgaggacgccaagctgcagctgtccaaggacacctacgacgacgacctggacaacctgctggcccagatcggcgaccagtacgccgacctgttcctggccgccaagaacctgtccgacgccatcctgctgtccgacatcctgcgggtgaacaccgagatcaccaaggcccccctgtccgcctccatgatcaagcggtacgacgagcaccaccaggacctgaccctgctgaaggccctggtgcggcagcagctgcccgagaagtacaaggagatcttcttcgaccagtccaagaacggctacgccggctacatcgacggcggcgcctcccaggaggagttctacaagttcatcaagcccatcctggagaagatggacggcaccgaggagctgctggtgaagctgaaccgggaggacctgctgcggaagcagcggaccttcgacaacggctccatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaactcccggttcgcctggatgacccggaagtccgaggagaccatcaccccctggaacttcgaggaggtggtggacaagggcgcctccgcccagtccttcatcgagcggatgaccaacttcgacaagaacctgcccaacgagaaggtgctgcccaagcactccctgctgtacgagtacttcaccgtgtacaacgagctgaccaaggtgaagtacgtgaccgagggcatgcggaagcccgccttcctgtccggcgagcagaagaaggccatcgtggacctgctgttcaagaccaaccggaaggtgaccgtgaagcagctgaaggaggactacttcaagaagatcgagtgcttcgactccgtggagatctccggcgtggaggaccggttcaacgcctccctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgtcccggaagctgatcaacggcatccgggacaagcagtccggcaagaccatcctggacttcctgaagtccgacggcttcgccaaccggaacttcatgcagctgatccacgacgactccctgaccttcaaggaggacatccagaaggcccaggtgtccggccagggcgactccctgcacgagcacatcgccaacctggccggctcccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaactcccgggagcggatgaagcggatcgaggagggcatcaaggagctgggctcccagatcctgaaggagcaccccgtggagaacacccagctgcagaacgagaagctgtacctgtactacctgcagaacggccgggacatgtacgtggaccaggagctggacatcaaccggctgtccgactacgacgtggacgccatcgtgccccagtccttcctgaaggacgactccatcgacaacaaggtgctgacccggtccgacaagaaccggggcaagtccgacaacgtgccctccgaggaggtggtgaagaagatgaagaactactggcggcagctgctgaacgccaagctgatcacccagcggaagttcgacaacctgaccaaggccgagcggggcggcctgtccgagctggacaaggccggcttcatcaagcggcagctggtggagacccggcagatcaccaagcacgtggcccagatcctggactcccggatgaacaccaagtacgacgagaacgacaagctgatccgggaggtgaaggtgatcaccctgaagtccaagctggtgtccgacttccggaaggacttccagttctacaaggtgcgggagatcaacaactaccaccacgcccacgacgcctacctgaacgccgtggtgggcaccgccctgatcaagaagtaccccaagctggagtccgagttcgtgtacggcgactacaaggtgtacgacgtgcggaagatgatcgccaagtccgagcaggagatcggcaaggccaccgccaagtacttcttctactccaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgtccatgccccaggtgaacatcgtgaagaagaccgaggtgcagaccggcggcttctccaaggagtccatcctgcccaagcggaactccgacaagctgatcgcccggaagaaggactgggaccccaagaagtacggcggcttcgactcccccaccgtggcctactccgtgctggtggtggccaaggtggagaagggcaagtccaagaagctgaagtccgtgaaggagctgctgggcatcaccatcatggagcggtcctccttcgagaagaaccccatcgacttcctggaggccaagggctacaaggaggtgaagaaggacctgatcatcaagctgcccaagtactccctgttcgagctggagaacggccggaagcggatgctggcctccgccggcgagctgcagaagggcaacgagctggccctgccctccaagtacgtgaacttcctgtacctggcctcccactacgagaagctgaagggctcccccgaggacaacgagcagaagcagctgttcgtggagcagcacaagcactacctggacgagatcatcgagcagatctccgagttctccaagcgggtgatcctggccgacgccaacctggacaaggtgctgtccgcctacaacaagcaccgggacaagcccatccgggagcaggccgagaacatcatccacctgttcaccctgaccaacctgggcgcccccgccgccttcaagtacttcgacaccaccatcgaccggaagcggtacacctccaccaaggaggtgctggacgccaccctgatccaccagtccatcaccggcctgtacgagacccggatcgacctgtcccagctgggcggcgac

SEQ ID NO: 154 - DNA, 4173 bp, Artificial Sequence
  Synthetic: dCas9 ORF using low A codons of Table 4, with two C-terminal NLS sequences (no start or stop codons; suitable for inclusion in fusion protein coding sequence)
gacaagaagtactccatcggcctggccatcggcaccaactccgtgggctgggccgtgatcaccgacgagtacaaggtgccctccaagaagttcaaggtgctgggcaacaccgaccggcactccatcaagaagaacctgatcggcgccctgctgttcgactccggcgagaccgccgaggccacccggctgaagcggaccgcccggcggcggtacacccggcggaagaaccggatctgctacctgcaggagatcttctccaacgagatggccaaggtggacgactccttcttccaccggctggaggagtccttcctggtggaggaggacaagaagcacgagcggcaccccatcttcggcaacatcgtggacgaggtggcctaccacgagaagtaccccaccatctaccacctgcggaagaagctggtggactccaccgacaaggccgacctgcggctgatctacctggccctggcccacatgatcaagttccggggccacttcctgatcgagggcgacctgaaccccgacaactccgacgtggacaagctgttcatccagctggtgcagacctacaaccagctgttcgaggagaaccccatcaacgcctccggcgtggacgccaaggccatcctgtccgcccggctgtccaagtcccggcggctggagaacctgatcgcccagctgcccggcgagaagaagaacggcctgttcggcaacctgatcgccctgtccctgggcctgacccccaacttcaagtccaacttcgacctggccgaggacgccaagctgcagctgtccaaggacacctacgacgacgacctggacaacctgctggcccagatcggcgaccagtacgccgacctgttcctggccgccaagaacctgtccgacgccatcctgctgtccgacatcctgcgggtgaacaccgagatcaccaaggcccccctgtccgcctccatgatcaagcggtacgacgagcaccaccaggacctgaccctgctgaaggccctggtgcggcagcagctgcccgagaagtacaaggagatcttcttcgaccagtccaagaacggctacgccggctacatcgacggcggcgcctcccaggaggagttctacaagttcatcaagcccatcctggagaagatggacggcaccgaggagctgctggtgaagctgaaccgggaggacctgctgcggaagcagcggaccttcgacaacggctccatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaactcccggttcgcctggatgacccggaagtccgaggagaccatcaccccctggaacttcgaggaggtggtggacaagggcgcctccgcccagtccttcatcgagcggatgaccaacttcgacaagaacctgcccaacgagaaggtgctgcccaagcactccctgctgtacgagtacttcaccgtgtacaacgagctgaccaaggtgaagtacgtgaccgagggcatgcggaagcccgccttcctgtccggcgagcagaagaaggccatcgtggacctgctgttcaagaccaaccggaaggtgaccgtgaagcagctgaaggaggactacttcaagaagatcgagtgcttcgactccgtggagatctccggcgtggaggaccggttcaacgcctccctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgtcccggaagctgatcaacggcatccgggacaagcagtccggcaagaccatcctggacttcctgaagtccgacggcttcgccaaccggaacttcatgcagctgatccacgacgactccctgaccttcaaggaggacatccagaaggcccaggtgtccggccagggcgactccctgcacgagcacatcgccaacctggccggctcccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaactcccgggagcggatgaagcggatcgaggagggcatcaaggagctgggctcccagatcctgaaggagcaccccgtggagaacacccagctgcagaacgagaagctgtacctgtactacctgcagaacggccgggacatgtacgtggaccaggagctggacatcaaccggctgtccgactacgacgtggacgccatcgtgccccagtccttcctgaaggacgactccatcgacaacaaggtgctgacccggtccgacaagaaccggggcaagtccgacaacgtgccctccgaggaggtggtgaagaagatgaagaactactggcggcagctgctgaacgccaagctgatcacccagcggaagttcgacaacctgaccaaggccgagcggggcggcctgtccgagctggacaaggccggcttcatcaagcggcagctggtggagacccggcagatcaccaagcacgtggcccagatcctggactcccggatgaacaccaagtacgacgagaacgacaagctgatccgggaggtgaaggtgatcaccctgaagtccaagctggtgtccgacttccggaaggacttccagttctacaaggtgcgggagatcaacaactaccaccacgcccacgacgcctacctgaacgccgtggtgggcaccgccctgatcaagaagtaccccaagctggagtccgagttcgtgtacggcgactacaaggtgtacgacgtgcggaagatgatcgccaagtccgagcaggagatcggcaaggccaccgccaagtacttcttctactccaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgtccatgccccaggtgaacatcgtgaagaagaccgaggtgcagaccggcggcttctccaaggagtccatcctgcccaagcggaactccgacaagctgatcgcccggaagaaggactgggaccccaagaagtacggcggcttcgactcccccaccgtggcctactccgtgctggtggtggccaaggtggagaagggcaagtccaagaagctgaagtccgtgaaggagctgctgggcatcaccatcatggagcggtcctccttcgagaagaaccccatcgacttcctggaggccaagggctacaaggaggtgaagaaggacctgatcatcaagctgcccaagtactccctgttcgagctggagaacggccggaagcggatgctggcctccgccggcgagctgcagaagggcaacgagctggccctgccctccaagtacgtgaacttcctgtacctggcctcccactacgagaagctgaagggctcccccgaggacaacgagcagaagcagctgttcgtggagcagcacaagcactacctggacgagatcatcgagcagatctccgagttctccaagcgggtgatcctggccgacgccaacctggacaaggtgctgtccgcctacaacaagcaccgggacaagcccatccgggagcaggccgagaacatcatccacctgttcaccctgaccaacctgggcgcccccgccgccttcaagtacttcgacaccaccatcgaccggaagcggtacacctccaccaaggaggtgctggacgccaccctgatccaccagtccatcaccggcctgtacgagacccggatcgacctgtcccagctgggcggcgacggctccggctcccccaagaagaagcggaaggtggacggctcccccaagaagaagcggaaggtggactccggc

SEQ ID NO: 155 - DNA, 4173 bp, Artificial Sequence
  Synthetic: Cas9 ORF using low A/U codons of Table 4, with two C-terminal NLS sequences (no start or stop codons; suitable for inclusion in fusion protein coding sequence)
gacaagaagtacagcatcggcctggacatcggcaccaacagcgtgggctgggccgtgatcaccgacgagtacaaggtgcccagcaagaagttcaaggtgctgggcaacaccgaccggcacagcatcaagaagaacctgatcggcgccctgctgttcgacagcggcgagaccgccgaggccacccggctgaagcggaccgcccggcggcggtacacccggcggaagaaccggatctgctacctgcaggagatcttcagcaacgagatggccaaggtggacgacagcttcttccaccggctggaggagagcttcctggtggaggaggacaagaagcacgagcggcaccccatcttcggcaacatcgtggacgaggtggcctaccacgagaagtaccccaccatctaccacctgcggaagaagctggtggacagcaccgacaaggccgacctgcggctgatctacctggccctggcccacatgatcaagttccggggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccggctgagcaagagccggcggctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgggtgaacaccgagatcaccaaggcccccctgagcgccagcatgatcaagcggtacgacgagcaccaccaggacctgaccctgctgaaggccctggtgcggcagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgggaggacctgctgcggaagcagcggaccttcgacaacggcagcatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaacagccggttcgcctggatgacccggaagagcgaggagaccatcaccccctggaacttcgaggaggtggtggacaagggcgccagcgcccagagcttcatcgagcggatgaccaacttcgacaagaacctgcccaacgagaaggtgctgcccaagcacagcctgctgtacgagtacttcaccgtgtacaacgagctgaccaaggtgaagtacgtgaccgagggcatgcggaagcccgccttcctgagcggcgagcagaagaaggccatcgtggacctgctgttcaagaccaaccggaaggtgaccgtgaagcagctgaaggaggactacttcaagaagatcgagtgcttcgacagcgtggagatcagcggcgtggaggaccggttcaacgccagcctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgagccggaagctgatcaacggcatccgggacaagcagagcggcaagaccatcctggacttcctgaagagcgacggcttcgccaaccggaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaacagccgggagcggatgaagcggatcgaggagggcatcaaggagctgggcagccagatcctgaaggagcaccccgtggagaacacccagctgcagaacgagaagctgtacctgtactacctgcagaacggccgggacatgtacgtggaccaggagctggacatcaaccggctgagcgactacgacgtggaccacatcgtgccccagagcttcctgaaggacgacagcatcgacaacaaggtgctgacccggagcgacaagaaccggggcaagagcgacaacgtgcccagcgaggaggtggtgaagaagatgaagaactactggcggcagctgctgaacgccaagctgatcacccagcggaagttcgacaacctgaccaaggccgagcggggcggcctgagcgagctggacaaggccggcttcatcaagcggcagctggtggagacccggcagatcaccaagcacgtggcccagatcctggacagccggatgaacaccaagtacgacgagaacgacaagctgatccgggaggtgaaggtgatcaccctgaagagcaagctggtgagcgacttccggaaggacttccagttctacaaggtgcgggagatcaacaactaccaccacgcccacgacgcctacctgaacgccgtggtgggcaccgccctgatcaagaagtaccccaagctggagagcgagttcgtgtacggcgactacaaggtgtacgacgtgcggaagatgatcgccaagagcgagcaggagatcggcaaggccaccgccaagtacttcttctacagcaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgagcatgccccaggtgaacatcgtgaagaagaccgaggtgcagaccggcggcttcagcaaggagagcatcctgcccaagcggaacagcgacaagctgatcgcccggaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcggagcagcttcgagaagaaccccatcgacttcctggaggccaagggctacaaggaggtgaagaaggacctgatcatcaagctgcccaagtacagcctgttcgagctggagaacggccggaagcggatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgggtgatcctggccgacgccaacctggacaaggtgctgagcgcctacaacaagcaccgggacaagcccatccgggagcaggccgagaacatcatccacctgttcaccctgaccaacctgggcgcccccgccgccttcaagtacttcgacaccaccatcgaccggaagcggtacaccagcaccaaggaggtgctggacgccaccctgatccaccagagcatcaccggcctgtacgagacccggatcgacctgagccagctgggcggcgacggcagcggcagccccaagaagaagcggaaggtggacggcagccccaagaagaagcggaaggtggacagcggc

SEQ ID NO: 156 - DNA, 4101 bp, Artificial Sequence
  Synthetic: Cas9 ORF using low A/U codons of Table 4 (no NLS and no start or stop codons; suitable for inclusion in fusion protein coding sequence)
gacaagaagtacagcatcggcctggacatcggcaccaacagcgtgggctgggccgtgatcaccgacgagtacaaggtgcccagcaagaagttcaaggtgctgggcaacaccgaccggcacagcatcaagaagaacctgatcggcgccctgctgttcgacagcggcgagaccgccgaggccacccggctgaagcggaccgcccggcggcggtacacccggcggaagaaccggatctgctacctgcaggagatcttcagcaacgagatggccaaggtggacgacagcttcttccaccggctggaggagagcttcctggtggaggaggacaagaagcacgagcggcaccccatcttcggcaacatcgtggacgaggtggcctaccacgagaagtaccccaccatctaccacctgcggaagaagctggtggacagcaccgacaaggccgacctgcggctgatctacctggccctggcccacatgatcaagttccggggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccggctgagcaagagccggcggctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgggtgaacaccgagatcaccaaggcccccctgagcgccagcatgatcaagcggtacgacgagcaccaccaggacctgaccctgctgaaggccctggtgcggcagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgggaggacctgctgcggaagcagcggaccttcgacaacggcagcatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaacagccggttcgcctggatgacccggaagagcgaggagaccatcaccccctggaacttcgaggaggtggtggacaagggcgccagcgcccagagcttcatcgagcggatgaccaacttcgacaagaacctgcccaacgagaaggtgctgcccaagcacagcctgctgtacgagtacttcaccgtgtacaacgagctgaccaaggtgaagtacgtgaccgagggcatgcggaagcccgccttcctgagcggcgagcagaagaaggccatcgtggacctgctgttcaagaccaaccggaaggtgaccgtgaagcagctgaaggaggactacttcaagaagatcgagtgcttcgacagcgtggagatcagcggcgtggaggaccggttcaacgccagcctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgagccggaagctgatcaacggcatccgggacaagcagagcggcaagaccatcctggacttcctgaagagcgacggcttcgccaaccggaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaacagccgggagcggatgaagcggatcgaggagggcatcaaggagctgggcagccagatcctgaaggagcaccccgtggagaacacccagctgcagaacgagaagctgtacctgtactacctgcagaacggccgggacatgtacgtggaccaggagctggacatcaaccggctgagcgactacgacgtggaccacatcgtgccccagagcttcctgaaggacgacagcatcgacaacaaggtgctgacccggagcgacaagaaccggggcaagagcgacaacgtgcccagcgaggaggtggtgaagaagatgaagaactactggcggcagctgctgaacgccaagctgatcacccagcggaagttcgacaacctgaccaaggccgagcggggcggcctgagcgagctggacaaggccggcttcatcaagcggcagctggtggagacccggcagatcaccaagcacgtggcccagatcctggacagccggatgaacaccaagtacgacgagaacgacaagctgatccgggaggtgaaggtgatcaccctgaagagcaagctggtgagcgacttccggaaggacttccagttctacaaggtgcgggagatcaacaactaccaccacgcccacgacgcctacctgaacgccgtggtgggcaccgccctgatcaagaagtaccccaagctggagagcgagttcgtgtacggcgactacaaggtgtacgacgtgcggaagatgatcgccaagagcgagcaggagatcggcaaggccaccgccaagtacttcttctacagcaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgagcatgccccaggtgaacatcgtgaagaagaccgaggtgcagaccggcggcttcagcaaggagagcatcctgcccaagcggaacagcgacaagctgatcgcccggaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcggagcagcttcgagaagaaccccatcgacttcctggaggccaagggctacaaggaggtgaagaaggacctgatcatcaagctgcccaagtacagcctgttcgagctggagaacggccggaagcggatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgggtgatcctggccgacgccaacctggacaaggtgctgagcgcctacaacaagcaccgggacaagcccatccgggagcaggccgagaacatcatccacctgttcaccctgaccaacctgggcgcccccgccgccttcaagtacttcgacaccaccatcgaccggaagcggtacaccagcaccaaggaggtgctggacgccaccctgatccaccagagcatcaccggcctgtacgagacccggatcgacctgagccagctgggcggcgac

SEQ ID NO: 157 - DNA, 4134 bp, Artificial Sequence
  Synthetic: Cas9 nickase ORF using low A/U codons of Table 4 (no start or stop codons; suitable for inclusion in fusion protein coding sequence)
gacaagaagtacagcatcggcctggccatcggcaccaacagcgtgggctgggccgtgatcaccgacgagtacaaggtgcccagcaagaagttcaaggtgctgggcaacaccgaccggcacagcatcaagaagaacctgatcggcgccctgctgttcgacagcggcgagaccgccgaggccacccggctgaagcggaccgcccggcggcggtacacccggcggaagaaccggatctgctacctgcaggagatcttcagcaacgagatggccaaggtggacgacagcttcttccaccggctggaggagagcttcctggtggaggaggacaagaagcacgagcggcaccccatcttcggcaacatcgtggacgaggtggcctaccacgagaagtaccccaccatctaccacctgcggaagaagctggtggacagcaccgacaaggccgacctgcggctgatctacctggccctggcccacatgatcaagttccggggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccggctgagcaagagccggcggctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgggtgaacaccgagatcaccaaggcccccctgagcgccagcatgatcaagcggtacgacgagcaccaccaggacctgaccctgctgaaggccctggtgcggcagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgggaggacctgctgcggaagcagcggaccttcgacaacggcagcatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaacagccggttcgcctggatgacccggaagagcgaggagaccatcaccccctggaacttcgaggaggtggtggacaagggcgccagcgcccagagcttcatcgagcggatgaccaacttcgacaagaacctgcccaacgagaaggtgctgcccaagcacagcctgctgtacgagtacttcaccgtgtacaacgagctgaccaaggtgaagtacgtgaccgagggcatgcggaagcccgccttcctgagcggcgagcagaagaaggccatcgtggacctgctgttcaagaccaaccggaaggtgaccgtgaagcagctgaaggaggactacttcaagaagatcgagtgcttcgacagcgtggagatcagcggcgtggaggaccggttcaacgccagcctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgagccggaagctgatcaacggcatccgggacaagcagagcggcaagaccatcctggacttcctgaagagcgacggcttcgccaaccggaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaacagccgggagcggatgaagcggatcgaggagggcatcaaggagctgggcagccagatcctgaaggagcaccccgtggagaacacccagctgcagaacgagaagctgtacctgtactacctgcagaacggccgggacatgtacgtggaccaggagctggacatcaaccggctgagcgactacgacgtggaccacatcgtgccccagagcttcctgaaggacgacagcatcgacaacaaggtgctgacccggagcgacaagaaccggggcaagagcgacaacgtgcccagcgaggaggtggtgaagaagatgaagaactactggcggcagctgctgaacgccaagctgatcacccagcggaagttcgacaacctgaccaaggccgagcggggcggcctgagcgagctggacaaggccggcttcatcaagcggcagctggtggagacccggcagatcaccaagcacgtggcccagatcctggacagccggatgaacaccaagtacgacgagaacgacaagctgatccgggaggtgaaggtgatcaccctgaagagcaagctggtgagcgacttccggaaggacttccagttctacaaggtgcgggagatcaacaactaccaccacgcccacgacgcctacctgaacgccgtggtgggcaccgccctgatcaagaagtaccccaagctggagagcgagttcgtgtacggcgactacaaggtgtacgacgtgcggaagatgatcgccaagagcgagcaggagatcggcaaggccaccgccaagtacttcttctacagcaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgagcatgccccaggtgaacatcgtgaagaagaccgaggtgcagaccggcggcttcagcaaggagagcatcctgcccaagcggaacagcgacaagctgatcgcccggaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcggagcagcttcgagaagaaccccatcgacttcctggaggccaagggctacaaggaggtgaagaaggacctgatcatcaagctgcccaagtacagcctgttcgagctggagaacggccggaagcggatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgggtgatcctggccgacgccaacctggacaaggtgctgagcgcctacaacaagcaccgggacaagcccatccgggagcaggccgagaacatcatccacctgttcaccctgaccaacctgggcgcccccgccgccttcaagtacttcgacaccaccatcgaccggaagcggtacaccagcaccaaggaggtgctggacgccaccctgatccaccagagcatcaccggcctgtacgagacccggatcgacctgagccagctgggcggcgacggcggcggcagccccaagaagaagcggaaggtg

SEQ ID NO: 158 - DNA, 4173 bp, Artificial Sequence
  Synthetic: Cas9 nickase ORF using low A/U codons of Table 4, with two C-terminal NLS sequences (no start or stop codons; suitable for inclusion in fusion protein coding sequence)
gacaagaagtacagcatcggcctggccatcggcaccaacagcgtgggctgggccgtgatcaccgacgagtacaaggtgcccagcaagaagttcaaggtgctgggcaacaccgaccggcacagcatcaagaagaacctgatcggcgccctgctgttcgacagcggcgagaccgccgaggccacccggctgaagcggaccgcccggcggcggtacacccggcggaagaaccggatctgctacctgcaggagatcttcagcaacgagatggccaaggtggacgacagcttcttccaccggctggaggagagcttcctggtggaggaggacaagaagcacgagcggcaccccatcttcggcaacatcgtggacgaggtggcctaccacgagaagtaccccaccatctaccacctgcggaagaagctggtggacagcaccgacaaggccgacctgcggctgatctacctggccctggcccacatgatcaagttccggggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccggctgagcaagagccggcggctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgggtgaacaccgagatcaccaaggcccccctgagcgccagcatgatcaagcggtacgacgagcaccaccaggacctgaccctgctgaaggccctggtgcggcagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgggaggacctgctgcggaagcagcggaccttcgacaacggcagcatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaacagccggttcgcctggatgacccggaagagcgaggagaccatcaccccctggaacttcgaggaggtggtggacaagggcgccagcgcccagagcttcatcgagcggatgaccaacttcgacaagaacctgcccaacgagaaggtgctgcccaagcacagcctgctgtacgagtacttcaccgtgtacaacgagctgaccaaggtgaagtacgtgaccgagggcatgcggaagcccgccttcctgagcggcgagcagaagaaggccatcgtggacctgctgttcaagaccaaccggaaggtgaccgtgaagcagctgaaggaggactacttcaagaagatcgagtgcttcgacagcgtggagatcagcggcgtggaggaccggttcaacgccagcctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgagccggaagctgatcaacggcatccgggacaagcagagcggcaagaccatcctggacttcctgaagagcgacggcttcgccaaccggaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaacagccgggagcggatgaagcggatcgaggagggcatcaaggagctgggcagccagatcctgaaggagcaccccgtggagaacacccagctgcagaacgagaagctgtacctgtactacctgcagaacggccgggacatgtacgtggaccaggagctggacatcaaccggctgagcgactacgacgtggaccacatcgtgccccagagcttcctgaaggacgacagcatcgacaacaaggtgctgacccggagcgacaagaaccggggcaagagcgacaacgtgcccagcgaggaggtggtgaagaagatgaagaactactggcggcagctgctgaacgccaagctgatcacccagcggaagttcgacaacctgaccaaggccgagcggggcggcctgagcgagctggacaaggccggcttcatcaagcggcagctggtggagacccggcagatcaccaagcacgtggcccagatcctggacagccggatgaacaccaagtacgacgagaacgacaagctgatccgggaggtgaaggtgatcaccctgaagagcaagctggtgagcgacttccggaaggacttccagttctacaaggtgcgggagatcaacaactaccaccacgcccacgacgcctacctgaacgccgtggtgggcaccgccctgatcaagaagtaccccaagctggagagcgagttcgtgtacggcgactacaaggtgtacgacgtgcggaagatgatcgccaagagcgagcaggagatcggcaaggccaccgccaagtacttcttctacagcaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgagcatgccccaggtgaacatcgtgaagaagaccgaggtgcagaccggcggcttcagcaaggagagcatcctgcccaagcggaacagcgacaagctgatcgcccggaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcggagcagcttcgagaagaaccccatcgacttcctggaggccaagggctacaaggaggtgaagaaggacctgatcatcaagctgcccaagtacagcctgttcgagctggagaacggccggaagcggatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgggtgatcctggccgacgccaacctggacaaggtgctgagcgcctacaacaagcaccgggacaagcccatccgggagcaggccgagaacatcatccacctgttcaccctgaccaacctgggcgcccccgccgccttcaagtacttcgacaccaccatcgaccggaagcggtacaccagcaccaaggaggtgctggacgccaccctgatccaccagagcatcaccggcctgtacgagacccggatcgacctgagccagctgggcggcgacggcagcggcagccccaagaagaagcggaaggtggacggcagccccaagaagaagcggaaggtggacagcggc

SEQ ID NO: 159 - DNA, 4101 bp, Artificial Sequence
  Synthetic: Cas9 nickase ORF using low A/U codons of Table 4 (no NLS and no start or stop codons; suitable for inclusion in fusion protein coding sequence)
gacaagaagtacagcatcggcctggccatcggcaccaacagcgtgggctgggccgtgatcaccgacgagtacaaggtgcccagcaagaagttcaaggtgctgggcaacaccgaccggcacagcatcaagaagaacctgatcggcgccctgctgttcgacagcggcgagaccgccgaggccacccggctgaagcggaccgcccggcggcggtacacccggcggaagaaccggatctgctacctgcaggagatcttcagcaacgagatggccaaggtggacgacagcttcttccaccggctggaggagagcttcctggtggaggaggacaagaagcacgagcggcaccccatcttcggcaacatcgtggacgaggtggcctaccacgagaagtaccccaccatctaccacctgcggaagaagctggtggacagcaccgacaaggccgacctgcggctgatctacctggccctggcccacatgatcaagttccggggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccggctgagcaagagccggcggctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgggtgaacaccgagatcaccaaggcccccctgagcgccagcatgatcaagcggtacgacgagcaccaccaggacctgaccctgctgaaggccctggtgcggcagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgggaggacctgctgcggaagcagcggaccttcgacaacggcagcatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaacagccggttcgcctggatgacccggaagagcgaggagaccatcaccccctggaacttcgaggaggtggtggacaagggcgccagcgcccagagcttcatcgagcggatgaccaacttcgacaagaacctgcccaacgagaaggtgctgcccaagcacagcctgctgtacgagtacttcaccgtgtacaacgagctgaccaaggtgaagtacgtgaccgagggcatgcggaagcccgccttcctgagcggcgagcagaagaaggccatcgtggacctgctgttcaagaccaaccggaaggtgaccgtgaagcagctgaaggaggactacttcaagaagatcgagtgcttcgacagcgtggagatcagcggcgtggaggaccggttcaacgccagcctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgagccggaagctgatcaacggcatccgggacaagcagagcggcaagaccatcctggacttcctgaagagcgacggcttcgccaaccggaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaacagccgggagcggatgaagcggatcgaggagggcatcaaggagctgggcagccagatcctgaaggagcaccccgtggagaacacccagctgcagaacgagaagctgtacctgtactacctgcagaacggccgggacatgtacgtggaccaggagctggacatcaaccggctgagcgactacgacgtggaccacatcgtgccccagagcttcctgaaggacgacagcatcgacaacaaggtgctgacccggagcgacaagaaccggggcaagagcgacaacgtgcccagcgaggaggtggtgaagaagatgaagaactactggcggcagctgctgaacgccaagctgatcacccagcggaagttcgacaacctgaccaaggccgagcggggcggcctgagcgagctggacaaggccggcttcatcaagcggcagctggtggagacccggcagatcaccaagcacgtggcccagatcctggacagccggatgaacaccaagtacgacgagaacgacaagctgatccgggaggtgaaggtgatcaccctgaagagcaagctggtgagcgacttccggaaggacttccagttctacaaggtgcgggagatcaacaactaccaccacgcccacgacgcctacctgaacgccgtggtgggcaccgccctgatcaagaagtaccccaagctggagagcgagttcgtgtacggcgactacaaggtgtacgacgtgcggaagatgatcgccaagagcgagcaggagatcggcaaggccaccgccaagtacttcttctacagcaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgagcatgccccaggtgaacatcgtgaagaagaccgaggtgcagaccggcggcttcagcaaggagagcatcctgcccaagcggaacagcgacaagctgatcgcccggaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcggagcagcttcgagaagaaccccatcgacttcctggaggccaagggctacaaggaggtgaagaaggacctgatcatcaagctgcccaagtacagcctgttcgagctggagaacggccggaagcggatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgggtgatcctggccgacgccaacctggacaaggtgctgagcgcctacaacaagcaccgggacaagcccatccgggagcaggccgagaacatcatccacctgttcaccctgaccaacctgggcgcccccgccgccttcaagtacttcgacaccaccatcgaccggaagcggtacaccagcaccaaggaggtgctggacgccaccctgatccaccagagcatcaccggcctgtacgagacccggatcgacctgagccagctgggcggcgac

SEQ ID NO: 160 - DNA, 4134 bp, Artificial Sequence
  Synthetic: dCas9 ORF using low A/U codons of Table 4 (no start or stop codons; suitable for inclusion in fusion protein coding sequence)
gacaagaagtacagcatcggcctggccatcggcaccaacagcgtgggctgggccgtgatcaccgacgagtacaaggtgcccagcaagaagttcaaggtgctgggcaacaccgaccggcacagcatcaagaagaacctgatcggcgccctgctgttcgacagcggcgagaccgccgaggccacccggctgaagcggaccgcccggcggcggtacacccggcggaagaaccggatctgctacctgcaggagatcttcagcaacgagatggccaaggtggacgacagcttcttccaccggctggaggagagcttcctggtggaggaggacaagaagcacgagcggcaccccatcttcggcaacatcgtggacgaggtggcctaccacgagaagtaccccaccatctaccacctgcggaagaagctggtggacagcaccgacaaggccgacctgcggctgatctacctggccctggcccacatgatcaagttccggggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccggctgagcaagagccggcggctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgggtgaacaccgagatcaccaaggcccccctgagcgccagcatgatcaagcggtacgacgagcaccaccaggacctgaccctgctgaaggccctggtgcggcagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgggaggacctgctgcggaagcagcggaccttcgacaacggcagcatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaacagccggttcgcctggatgacccggaagagcgaggagaccatcaccccctggaacttcgaggaggtggtggacaagggcgccagcgcccagagcttcatcgagcggatgaccaacttcgacaagaacctgcccaacgagaaggtgctgcccaagcacagcctgctgtacgagtacttcaccgtgtacaacgagctgaccaaggtgaagtacgtgaccgagggcatgcggaagcccgccttcctgagcggcgagcagaagaaggccatcgtggacctgctgttcaagaccaaccggaaggtgaccgtgaagcagctgaaggaggactacttcaagaagatcgagtgcttcgacagcgtggagatcagcggcgtggaggaccggttcaacgccagcctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgagccggaagctgatcaacggcatccgggacaagcagagcggcaagaccatcctggacttcctgaagagcgacggcttcgccaaccggaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaacagccgggagcggatgaagcggatcgaggagggcatcaaggagctgggcagccagatcctgaaggagcaccccgtggagaacacccagctgcagaacgagaagctgtacctgtactacctgcagaacggccgggacatgtacgtggaccaggagctggacatcaaccggctgagcgactacgacgtggacgccatcgtgccccagagcttcctgaaggacgacagcatcgacaacaaggtgctgacccggagcgacaagaaccggggcaagagcgacaacgtgcccagcgaggaggtggtgaagaagatgaagaactactggcggcagctgctgaacgccaagctgatcacccagcggaagttcgacaacctgaccaaggccgagcggggcggcctgagcgagctggacaaggccggcttcatcaagcggcagctggtggagacccggcagatcaccaagcacgtggcccagatcctggacagccggatgaacaccaagtacgacgagaacgacaagctgatccgggaggtgaaggtgatcaccctgaagagcaagctggtgagcgacttccggaaggacttccagttctacaaggtgcgggagatcaacaactaccaccacgcccacgacgcctacctgaacgccgtggtgggcaccgccctgatcaagaagtaccccaagctggagagcgagttcgtgtacggcgactacaaggtgtacgacgtgcggaagatgatcgccaagagcgagcaggagatcggcaaggccaccgccaagtacttcttctacagcaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgagcatgccccaggtgaacatcgtgaagaagaccgaggtgcagaccggcggcttcagcaaggagagcatcctgcccaagcggaacagcgacaagctgatcgcccggaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcggagcagcttcgagaagaaccccatcgacttcctggaggccaagggctacaaggaggtgaagaaggacctgatcatcaagctgcccaagtacagcctgttcgagctggagaacggccggaagcggatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgggtgatcctggccgacgccaacctggacaaggtgctgagcgcctacaacaagcaccgggacaagcccatccgggagcaggccgagaacatcatccacctgttcaccctgaccaacctgggcgcccccgccgccttcaagtacttcgacaccaccatcgaccggaagcggtacaccagcaccaaggaggtgctggacgccaccctgatccaccagagcatcaccggcctgtacgagacccggatcgacctgagccagctgggcggcgacggcggcggcagccccaagaagaagcggaaggtg

SEQ ID NO: 161 - DNA, 4173 bp, Artificial Sequence
  Synthetic: dCas9 ORF using low A/U codons of Table 4, with two C-terminal NLS sequences (no start or stop codons; suitable for inclusion in fusion protein coding sequence)
gacaagaagtacagcatcggcctggccatcggcaccaacagcgtgggctgggccgtgatcaccgacgagtacaaggtgcccagcaagaagttcaaggtgctgggcaacaccgaccggcacagcatcaagaagaacctgatcggcgccctgctgttcgacagcggcgagaccgccgaggccacccggctgaagcggaccgcccggcggcggtacacccggcggaagaaccggatctgctacctgcaggagatcttcagcaacgagatggccaaggtggacgacagcttcttccaccggctggaggagagcttcctggtggaggaggacaagaagcacgagcggcaccccatcttcggcaacatcgtggacgaggtggcctaccacgagaagtaccccaccatctaccacctgcggaagaagctggtggacagcaccgacaaggccgacctgcggctgatctacctggccctggcccacatgatcaagttccggggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccggctgagcaagagccggcggctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgggtgaacaccgagatcaccaaggcccccctgagcgccagcatgatcaagcggtacgacgagcaccaccaggacctgaccctgctgaaggccctggtgcggcagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgggaggacctgctgcggaagcagcggaccttcgacaacggcagcatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaacagccggttcgcctggatgacccggaagagcgaggagaccatcaccccctggaacttcgaggaggtggtggacaagggcgccagcgcccagagcttcatcgagcggatgaccaacttcgacaagaacctgcccaacgagaaggtgctgcccaagcacagcctgctgtacgagtacttcaccgtgtacaacgagctgaccaaggtgaagtacgtgaccgagggcatgcggaagcccgccttcctgagcggcgagcagaagaaggccatcgtggacctgctgttcaagaccaaccggaaggtgaccgtgaagcagctgaaggaggactacttcaagaagatcgagtgcttcgacagcgtggagatcagcggcgtggaggaccggttcaacgccagcctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgagccggaagctgatcaacggcatccgggacaagcagagcggcaagaccatcctggacttcctgaagagcgacggcttcgccaaccggaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaacagccgggagcggatgaagcggatcgaggagggcatcaaggagctgggcagccagatcctgaaggagcaccccgtggagaacacccagctgcagaacgagaagctgtacctgtactacctgcagaacggccgggacatgtacgtggaccaggagctggacatcaaccggctgagcgactacgacgtggacgccatcgtgccccagagcttcctgaaggacgacagcatcgacaacaaggtgctgacccggagcgacaagaaccggggcaagagcgacaacgtgcccagcgaggaggtggtgaagaagatgaagaactactggcggcagctgctgaacgccaagctgatcacccagcggaagttcgacaacctgaccaaggccgagcggggcggcctgagcgagctggacaaggccggcttcatcaagcggcagctggtggagacccggcagatcaccaagcacgtggcccagatcctggacagccggatgaacaccaagtacgacgagaacgacaagctgatccgggaggtgaaggtgatcaccctgaagagcaagctggtgagcgacttccggaaggacttccagttctacaaggtgcgggagatcaacaactaccaccacgcccacgacgcctacctgaacgccgtggtgggcaccgccctgatcaagaagtaccccaagctggagagcgagttcgtgtacggcgactacaaggtgtacgacgtgcggaagatgatcgccaagagcgagcaggagatcggcaaggccaccgccaagtacttcttctacagcaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgagcatgccccaggtgaacatcgtgaagaagaccgaggtgcagaccggcggcttcagcaaggagagcatcctgcccaagcggaacagcgacaagctgatcgcccggaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcggagcagcttcgagaagaaccccatcgacttcctggaggccaagggctacaaggaggtgaagaaggacctgatcatcaagctgcccaagtacagcctgttcgagctggagaacggccggaagcggatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgggtgatcctggccgacgccaacctggacaaggtgctgagcgcctacaacaagcaccgggacaagcccatccgggagcaggccgagaacatcatccacctgttcaccctgaccaacctgggcgcccccgccgccttcaagtacttcgacaccaccatcgaccggaagcggtacaccagcaccaaggaggtgctggacgccaccctgatccaccagagcatcaccggcctgtacgagacccggatcgacctgagccagctgggcggcgacggcagcggcagccccaagaagaagcggaaggtggacggcagccccaagaagaagcggaaggtggacagcggc

SEQ ID NO: 162 - DNA, 4101 bp, Artificial Sequence
  Synthetic: dCas9 ORF using low A/U codons of Table 4 (no NLS and no start or stop codons; suitable for inclusion in fusion protein coding sequence)
gacaagaagtacagcatcggcctggccatcggcaccaacagcgtgggctgggccgtgatcaccgacgagtacaaggtgcccagcaagaagttcaaggtgctgggcaacaccgaccggcacagcatcaagaagaacctgatcggcgccctgctgttcgacagcggcgagaccgccgaggccacccggctgaagcggaccgcccggcggcggtacacccggcggaagaaccggatctgctacctgcaggagatcttcagcaacgagatggccaaggtggacgacagcttcttccaccggctggaggagagcttcctggtggaggaggacaagaagcacgagcggcaccccatcttcggcaacatcgtggacgaggtggcctaccacgagaagtaccccaccatctaccacctgcggaagaagctggtggacagcaccgacaaggccgacctgcggctgatctacctggccctggcccacatgatcaagttccggggccacttcctgatcgagggcgacctgaaccccgacaacagcgacgtggacaagctgttcatccagctggtgcagacctacaaccagctgttcgaggagaaccccatcaacgccagcggcgtggacgccaaggccatcctgagcgcccggctgagcaagagccggcggctggagaacctgatcgcccagctgcccggcgagaagaagaacggcctgttcggcaacctgatcgccctgagcctgggcctgacccccaacttcaagagcaacttcgacctggccgaggacgccaagctgcagctgagcaaggacacctacgacgacgacctggacaacctgctggcccagatcggcgaccagtacgccgacctgttcctggccgccaagaacctgagcgacgccatcctgctgagcgacatcctgcgggtgaacaccgagatcaccaaggcccccctgagcgccagcatgatcaagcggtacgacgagcaccaccaggacctgaccctgctgaaggccctggtgcggcagcagctgcccgagaagtacaaggagatcttcttcgaccagagcaagaacggctacgccggctacatcgacggcggcgccagccaggaggagttctacaagttcatcaagcccatcctggagaagatggacggcaccgaggagctgctggtgaagctgaaccgggaggacctgctgcggaagcagcggaccttcgacaacggcagcatcccccaccagatccacctgggcgagctgcacgccatcctgcggcggcaggaggacttctaccccttcctgaaggacaaccgggagaagatcgagaagatcctgaccttccggatcccctactacgtgggccccctggcccggggcaacagccggttcgcctggatgacccggaagagcgaggagaccatcaccccctggaacttcgaggaggtggtggacaagggcgccagcgcccagagcttcatcgagcggatgaccaacttcgacaagaacctgcccaacgagaaggtgctgcccaagcacagcctgctgtacgagtacttcaccgtgtacaacgagctgaccaaggtgaagtacgtgaccgagggcatgcggaagcccgccttcctgagcggcgagcagaagaaggccatcgtggacctgctgttcaagaccaaccggaaggtgaccgtgaagcagctgaaggaggactacttcaagaagatcgagtgcttcgacagcgtggagatcagcggcgtggaggaccggttcaacgccagcctgggcacctaccacgacctgctgaagatcatcaaggacaaggacttcctggacaacgaggagaacgaggacatcctggaggacatcgtgctgaccctgaccctgttcgaggaccgggagatgatcgaggagcggctgaagacctacgcccacctgttcgacgacaaggtgatgaagcagctgaagcggcggcggtacaccggctggggccggctgagccggaagctgatcaacggcatccgggacaagcagagcggcaagaccatcctggacttcctgaagagcgacggcttcgccaaccggaacttcatgcagctgatccacgacgacagcctgaccttcaaggaggacatccagaaggcccaggtgagcggccagggcgacagcctgcacgagcacatcgccaacctggccggcagccccgccatcaagaagggcatcctgcagaccgtgaaggtggtggacgagctggtgaaggtgatgggccggcacaagcccgagaacatcgtgatcgagatggcccgggagaaccagaccacccagaagggccagaagaacagccgggagcggatgaagcggatcgaggagggcatcaaggagctgggcagccagatcctgaaggagcaccccgtggagaacacccagctgcagaacgagaagctgtacctgtactacctgcagaacggccgggacatgtacgtggaccaggagctggacatcaaccggctgagcgactacgacgtggacgccatcgtgccccagagcttcctgaaggacgacagcatcgacaacaaggtgctgacccggagcgacaagaaccggggcaagagcgacaacgtgcccagcgaggaggtggtgaagaagatgaagaactactggcggcagctgctgaacgccaagctgatcacccagcggaagttcgacaacctgaccaaggccgagcggggcggcctgagcgagctggacaaggccggcttcatcaagcggcagctggtggagacccggcagatcaccaagcacgtggcccagatcctggacagccggatgaacaccaagtacgacgagaacgacaagctgatccgggaggtgaaggtgatcaccctgaagagcaagctggtgagcgacttccggaaggacttccagttctacaaggtgcgggagatcaacaactaccaccacgcccacgacgcctacctgaacgccgtggtgggcaccgccctgatcaagaagtaccccaagctggagagcgagttcgtgtacggcgactacaaggtgtacgacgtgcggaagatgatcgccaagagcgagcaggagatcggcaaggccaccgccaagtacttcttctacagcaacatcatgaacttcttcaagaccgagatcaccctggccaacggcgagatccggaagcggcccctgatcgagaccaacggcgagaccggcgagatcgtgtgggacaagggccgggacttcgccaccgtgcggaaggtgctgagcatgccccaggtgaacatcgtgaagaagaccgaggtgcagaccggcggcttcagcaaggagagcatcctgcccaagcggaacagcgacaagctgatcgcccggaagaaggactgggaccccaagaagtacggcggcttcgacagccccaccgtggcctacagcgtgctggtggtggccaaggtggagaagggcaagagcaagaagctgaagagcgtgaaggagctgctgggcatcaccatcatggagcggagcagcttcgagaagaaccccatcgacttcctggaggccaagggctacaaggaggtgaagaaggacctgatcatcaagctgcccaagtacagcctgttcgagctggagaacggccggaagcggatgctggccagcgccggcgagctgcagaagggcaacgagctggccctgcccagcaagtacgtgaacttcctgtacctggccagccactacgagaagctgaagggcagccccgaggacaacgagcagaagcagctgttcgtggagcagcacaagcactacctggacgagatcatcgagcagatcagcgagttcagcaagcgggtgatcctggccgacgccaacctggacaaggtgctgagcgcctacaacaagcaccgggacaagcccatccgggagcaggccgagaacatcatccacctgttcaccctgaccaacctgggcgcccccgccgccttcaagtacttcgacaccaccatcgaccggaagcggtacaccagcaccaaggaggtgctggacgccaccctgatccaccagagcatcaccggcctgtacgagacccggatcgacctgagccagctgggcggcgac

SEQ ID NO: 163 - DNA, 3306 bp, Artificial Sequence
  Synthetic: Nme Cas9 ORF using low A codons of Table 4 (no start or stop codons; suitable for inclusion in fusion protein coding sequence)
gccgccttcaagcccaactccatcaactacatcctgggcctggacatcggcatcgcctccgtgggctgggccatggtggagatcgacgaggaggagaaccccatccggctgatcgacctgggcgtgcgggtgttcgagcgggccgaggtgcccaagaccggcgactccctggccatggcccggcggctggcccggtccgtgcggcggctgacccggcggcgggcccaccggctgctgcggacccggcggctgctgaagcgggagggcgtgctgcaggccgccaacttcgacgagaacggcctgatcaagtccctgcccaacaccccctggcagctgcgggccgccgccctggaccggaagctgacccccctggagtggtccgccgtgctgctgcacctgatcaagcaccggggctacctgtcccagcggaagaacgagggcgagaccgccgacaaggagctgggcgccctgctgaagggcgtggccggcaacgcccacgccctgcagaccggcgacttccggacccccgccgagctggccctgaacaagttcgagaaggagtccggccacatccggaaccagcggtccgactactcccacaccttctcccggaaggacctgcaggccgagctgatcctgctgttcgagaagcagaaggagttcggcaacccccacgtgtccggcggcctgaaggagggcatcgagaccctgctgatgacccagcggcccgccctgtccggcgacgccgtgcagaagatgctgggccactgcaccttcgagcccgccgagcccaaggccgccaagaacacctacaccgccgagcggttcatctggctgaccaagctgaacaacctgcggatcctggagcagggctccgagcggcccctgaccgacaccgagcgggccaccctgatggacgagccctaccggaagtccaagctgacctacgcccaggcccggaagctgctgggcctggaggacaccgccttcttcaagggcctgcggtacggcaaggacaacgccgaggcctccaccctgatggagatgaaggcctaccacgccatctcccgggccctggagaaggagggcctgaaggacaagaagtcccccctgaacctgtcccccgagctgcaggacgagatcggcaccgccttctccctgttcaagaccgacgaggacatcaccggccggctgaaggaccggatccagcccgagatcctggaggccctgctgaagcacatctccttcgacaagttcgtgcagatctccctgaaggccctgcggcggatcgtgcccctgatggagcagggcaagcggtacgacgaggcctgcgccgagatctacggcgaccactacggcaagaagaacaccgaggagaagatctacctgccccccatccccgccgacgagatccggaaccccgtggtgctgcgggccctgtcccaggcccggaaggtgatcaacggcgtggtgcggcggtacggctcccccgcccggatccacatcgagaccgcccgggaggtgggcaagtccttcaaggaccggaaggagatcgagaagcggcaggaggagaaccggaaggaccgggagaaggccgccgccaagttccgggagtacttccccaacttcgtgggcgagcccaagtccaaggacatcctgaagctgcggctgtacgagcagcagcacggcaagtgcctgtactccggcaaggagatcaacctgggccggctgaacgagaagggctacgtggagatcgaccacgccctgcccttctcccggacctgggacgactccttcaacaacaaggtgctggtgctgggctccgagaaccagaacaagggcaaccagaccccctacgagtacttcaacggcaaggacaactcccgggagtggcaggagttcaaggcccgggtggagacctcccggttcccccggtccaagaagcagcggatcctgctgcagaagttcgacgaggacggcttcaaggagcggaacctgaacgacacccggtacgtgaaccggttcctgtgccagttcgtggccgaccggatgcggctgaccggcaagggcaagaagcgggtgttcgcctccaacggccagatcaccaacctgctgcggggcttctggggcctgcggaaggtgcgggccgagaacgaccggcaccacgccctggacgccgtggtggtggcctgctccaccgtggccatgcagcagaagatcacccggttcgtgcggtacaaggagatgaacgccttcgacggcaagaccatcgacaaggagaccggcgaggtgctgcaccagaagacccacttcccccagccctgggagttcttcgcccaggaggtgatgatccgggtgttcggcaagcccgacggcaagcccgagttcgaggaggccgacaccctggagaagctgcggaccctgctggccgagaagctgtcctcccggcccgaggccgtgcacgagtacgtgacccccctgttcgtgtcccgggcccccaaccggaagatgtccggccagggccacatggagaccgtgaagtccgccaagcggctggacgagggcgtgtccgtgctgcgggtgcccctgacccagctgaagctgaaggacctggagaagatggtgaaccgggagcgggagcccaagctgtacgaggccctgaaggcccggctggaggcccacaaggacgaccccgccaaggccttcgccgagcccttctacaagtacgacaaggccggcaaccggacccagcaggtgaaggccgtgcgggtggagcaggtgcagaagaccggcgtgtgggtgcggaaccacaacggcatcgccgacaacgccaccatggtgcgggtggacgtgttcgagaagggcgacaagtactacctggtgcccatctactcctggcaggtggccaagggcatcctgcccgaccgggccgtggtgcagggcaaggacgaggaggactggcagctgatcgacgactccttcaacttcaagttctccctgcaccccaacgacctggtggaggtgatcaccaagaaggcccggatgttcggctacttcgcctcctgccaccggggcaccggcaacatcaacatccggatccacgacctggaccacaagatcggcaagaacggcatcctggagggcatcggcgtgaagaccgccctgtccttccagaagtaccagatcgacgagctgggcaaggagatccggccctgccggctgaagaagcggccccccgtgcggtccggcaagcggaccgccgacggctccgagttcgagtcccccaagaagaagcggaaggtggag

SEQ ID NO: 164 - DNA, 3306 bp, Artificial Sequence
  Synthetic: Nme Cas9 ORF using low A/U codons of Table 4 (no start or stop codons; suitable for inclusion in fusion protein coding sequence)
gccgccttcaagcccaacagcatcaactacatcctgggcctggacatcggcatcgccagcgtgggctgggccatggtggagatcgacgaggaggagaaccccatccggctgatcgacctgggcgtgcgggtgttcgagcgggccgaggtgcccaagaccggcgacagcctggccatggcccggcggctggcccggagcgtgcggcggctgacccggcggcgggcccaccggctgctgcggacccggcggctgctgaagcgggagggcgtgctgcaggccgccaacttcgacgagaacggcctgatcaagagcctgcccaacaccccctggcagctgcgggccgccgccctggaccggaagctgacccccctggagtggagcgccgtgctgctgcacctgatcaagcaccggggctacctgagccagcggaagaacgagggcgagaccgccgacaaggagctgggcgccctgctgaagggcgtggccggcaacgcccacgccctgcagaccggcgacttccggacccccgccgagctggccctgaacaagttcgagaaggagagcggccacatccggaaccagcggagcgactacagccacaccttcagccggaaggacctgcaggccgagctgatcctgctgttcgagaagcagaaggagttcggcaacccccacgtgagcggcggcctgaaggagggcatcgagaccctgctgatgacccagcggcccgccctgagcggcgacgccgtgcagaagatgctgggccactgcaccttcgagcccgccgagcccaaggccgccaagaacacctacaccgccgagcggttcatctggctgaccaagctgaacaacctgcggatcctggagcagggcagcgagcggcccctgaccgacaccgagcgggccaccctgatggacgagccctaccggaagagcaagctgacctacgcccaggcccggaagctgctgggcctggaggacaccgccttcttcaagggcctgcggtacggcaaggacaacgccgaggccagcaccctgatggagatgaaggcctaccacgccatcagccgggccctggagaaggagggcctgaaggacaagaagagccccctgaacctgagccccgagctgcaggacgagatcggcaccgccttcagcctgttcaagaccgacgaggacatcaccggccggctgaaggaccggatccagcccgagatcctggaggccctgctgaagcacatcagcttcgacaagttcgtgcagatcagcctgaaggccctgcggcggatcgtgcccctgatggagcagggcaagcggtacgacgaggcctgcgccgagatctacggcgaccactacggcaagaagaacaccgaggagaagatctacctgccccccatccccgccgacgagatccggaaccccgtggtgctgcgggccctgagccaggcccggaaggtgatcaacggcgtggtgcggcggtacggcagccccgcccggatccacatcgagaccgcccgggaggtgggcaagagcttcaaggaccggaaggagatcgagaagcggcaggaggagaaccggaaggaccgggagaaggccgccgccaagttccgggagtacttccccaacttcgtgggcgagcccaagagcaaggacatcctgaagctgcggctgtacgagcagcagcacggcaagtgcctgtacagcggcaaggagatcaacctgggccggctgaacgagaagggctacgtggagatcgaccacgccctgcccttcagccggacctgggacgacagcttcaacaacaaggtgctggtgctgggcagcgagaaccagaacaagggcaaccagaccccctacgagtacttcaacggcaaggacaacagccgggagtggcaggagttcaaggcccgggtggagaccagccggttcccccggagcaagaagcagcggatcctgctgcagaagttcgacgaggacggcttcaaggagcggaacctgaacgacacccggtacgtgaaccggttcctgtgccagttcgtggccgaccggatgcggctgaccggcaagggcaagaagcgggtgttcgccagcaacggccagatcaccaacctgctgcggggcttctggggcctgcggaaggtgcgggccgagaacgaccggcaccacgccctggacgccgtggtggtggcctgcagcaccgtggccatgcagcagaagatcacccggttcgtgcggtacaaggagatgaacgccttcgacggcaagaccatcgacaaggagaccggcgaggtgctgcaccagaagacccacttcccccagccctgggagttcttcgcccaggaggtgatgatccgggtgttcggcaagcccgacggcaagcccgagttcgaggaggccgacaccctggagaagctgcggaccctgctggccgagaagctgagcagccggcccgaggccgtgcacgagtacgtgacccccctgttcgtgagccgggcccccaaccggaagatgagcggccagggccacatggagaccgtgaagagcgccaagcggctggacgagggcgtgagcgtgctgcgggtgcccctgacccagctgaagctgaaggacctggagaagatggtgaaccgggagcgggagcccaagctgtacgaggccctgaaggcccggctggaggcccacaaggacgaccccgccaaggccttcgccgagcccttctacaagtacgacaaggccggcaaccggacccagcaggtgaaggccgtgcgggtggagcaggtgcagaagaccggcgtgtgggtgcggaaccacaacggcatcgccgacaacgccaccatggtgcgggtggacgtgttcgagaagggcgacaagtactacctggtgcccatctacagctggcaggtggccaagggcatcctgcccgaccgggccgtggtgcagggcaaggacgaggaggactggcagctgatcgacgacagcttcaacttcaagttcagcctgcaccccaacgacctggtggaggtgatcaccaagaaggcccggatgttcggctacttcgccagctgccaccggggcaccggcaacatcaacatccggatccacgacctggaccacaagatcggcaagaacggcatcctggagggcatcggcgtgaagaccgccctgagcttccagaagtaccagatcgacgagctgggcaaggagatccggccctgccggctgaagaagcggccccccgtgcggagcggcaagcggaccgccgacggcagcgagttcgagagccccaagaagaagcggaaggtggag

SEQ ID NO: 165 - DNA, 4140 bp, Artificial Sequence
  Synthetic: Open reading frame for Cas9 with NLS1 (no start or stop codons; suitable for inclusion in fusion protein coding sequence)
gacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcctggcagcaaagagaagcagaacaaca

SEQ ID NO: 166 - DNA, 4140 bp, Artificial Sequence
  Synthetic: Open reading frame for Cas9 with NLS2 (no start or stop codons; suitable for inclusion in fusion protein coding sequence)
gacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagccaggcagcaaagagaagcagaacaaca

SEQ ID NO: 167 - DNA, 4143 bp, Artificial Sequence
  Synthetic: Open reading frame for Cas9 with NLS3 (no start or stop codons; suitable for inclusion in fusion protein coding sequence)
gacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcccggcaccggcaaagagagaaagaacaaca

SEQ ID NO: 168 - DNA, 4140 bp, Artificial Sequence
  Synthetic: Open reading frame for Cas9 with NLS4 (no start or stop codons; suitable for inclusion in fusion protein coding sequence)
gacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagccaggcagcaaagagaccgagaacaaca

SEQ ID NO: 169 - DNA, 4140 bp, Artificial Sequence
  Synthetic: Open reading frame for Cas9 with NLS5 (no start or stop codons; suitable for inclusion in fusion protein coding sequence)
gacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcagagcagcaaagagaccgagaacaaca

SEQ ID NO: 170 - DNA, 4146 bp, Artificial Sequence
  Synthetic: Open reading frame for Cas9 with NLS6 (no start or stop codons; suitable for inclusion in fusion protein coding sequence)
gacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcgcagcagcaaagagaagctggagcatggcagca

SEQ ID NO: 171 - DNA, 4146 bp, Artificial Sequence
  Synthetic: Open reading frame for Cas9 with NLS7 (no start or stop codons; suitable for inclusion in fusion protein coding sequence)
gacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcgcagcagcaaagagagtctggagcatggcattc

SEQ ID NO: 172 - DNA, 4146 bp, Artificial Sequence
  Synthetic: Open reading frame for Cas9 with NLS8 (no start or stop codons; suitable for inclusion in fusion protein coding sequence)
gacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcgcagcagcaaagagaagctggagcatggcattc

SEQ ID NO: 173 - DNA, 4143 bp, Artificial Sequence
  Synthetic: Open reading frame for Cas9 with NLS9 (no start or stop codons; suitable for inclusion in fusion protein coding sequence)
gacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcgcagcagcaaagagaaagtacttcgcagca

SEQ ID NO: 174 - DNA, 4143 bp, Artificial Sequence
  Synthetic: Open reading frame for Cas9 with NLS10 (no start or stop codons; suitable for inclusion in fusion protein coding sequence)
gacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcagagcagcaaagagaaaggcattcgcagca

SEQ ID NO: 175 - DNA, 4143 bp, Artificial Sequence
  Synthetic: Open reading frame for Cas9 with NLS11 (no start or stop codons; suitable for inclusion in fusion protein coding sequence)
gacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcagagcagcaaagagaaagtacttcgcagtc

SEQ ID NO: 176 - RNA, 4423 nt, Artificial Sequence
  Synthetic: mRNA transcript with XBG UTRs and Cas9 ORF with low U 1 codons of Table 4
gggaagcucagaauaaacgcucaacuuuggccggaucugccaccauggacaagaaguacagcaucggccuggacaucggcaccaacagcgugggcugggccgugaucaccgacgaguacaaggugcccagcaagaaguucaaggugcugggcaacaccgacagacacagcaucaagaagaaccugaucggcgcccugcuguucgacagcggcgagaccgccgaggccaccagacugaagagaaccgccagaagaagauacaccagaagaaagaacagaaucugcuaccugcaggagaucuucagcaacgagauggccaagguggacgacagcuucuuccacagacuggaggagagcuuccugguggaggaggacaagaagcacgagagacaccccaucuucggcaacaucguggacgagguggccuaccacgagaaguaccccaccaucuaccaccugagaaagaagcugguggacagcaccgacaaggccgaccugagacugaucuaccuggcccuggcccacaugaucaaguucagaggccacuuccugaucgagggcgaccugaaccccgacaacagcgacguggacaagcuguucauccagcuggugcagaccuacaaccagcuguucgaggagaaccccaucaacgccagcggcguggacgccaaggccauccugagcgccagacugagcaagagcagaagacuggagaaccugaucgcccagcugcccggcgagaagaagaacggccuguucggcaaccugaucgcccugagccugggccugacccccaacuucaagagcaacuucgaccuggccgaggacgccaagcugcagcugagcaaggacaccuacgacgacgaccuggacaaccugcuggcccagaucggcgaccaguacgccgaccuguuccuggccgccaagaaccugagcgacgccauccugcugagcgacauccugagagugaacaccgagaucaccaaggccccccugagcgccagcaugaucaagagauacgacgagcaccaccaggaccugacccugcugaaggcccuggugagacagcagcugcccgagaaguacaaggagaucuucuucgaccagagcaagaacggcuacgccggcuacaucgacggcggcgccagccaggaggaguucuacaaguucaucaagcccauccuggagaagauggacggcaccgaggagcugcuggugaagcugaacagagaggaccugcugagaaagcagagaaccuucgacaacggcagcaucccccaccagauccaccugggcgagcugcacgccauccugagaagacaggaggacuucuaccccuuccugaaggacaacagagagaagaucgagaagauccugaccuucagaauccccuacuacgugggcccccuggccagaggcaacagcagauucgccuggaugaccagaaagagcgaggagaccaucacccccuggaacuucgaggaggugguggacaagggcgccagcgcccagagcuucaucgagagaaugaccaacuucgacaagaaccugcccaacgagaaggugcugcccaagcacagccugcuguacgaguacuucaccguguacaacgagcugaccaaggugaaguacgugaccgagggcaugagaaagcccgccuuccugagcggcgagcagaagaaggccaucguggaccugcuguucaagaccaacagaaaggugaccgugaagcagcugaaggaggacuacuucaagaagaucgagugcuucgacagcguggagaucagcggcguggaggacagauucaacgccagccugggcaccuaccacgaccugcugaagaucaucaaggacaaggacuuccuggacaacgaggagaacgaggacauccuggaggacaucgugcugacccugacccuguucgaggacagagagaugaucgaggagagacugaagaccuacgcccaccuguucgacgacaaggugaugaagcagcugaagagaagaagauacaccggcuggggcagacugagcagaaagcugaucaacggcaucagagacaagcagagcggcaagaccauccuggacuuccugaagagcgacggcuucgccaacagaaacuucaugcagcugauccacgacgacagccugaccuucaaggaggacauccagaaggcccaggugagcggccagggcgacagccugcacgagcacaucgccaaccuggccggcagccccgccaucaagaagggcauccugcagaccgugaaggugguggacgagcuggugaaggugaugggcagacacaagcccgagaacaucgugaucgagauggccagagagaaccagaccacccagaagggccagaagaacagcagagagagaaugaagagaaucgaggagggcaucaaggagcugggcagccagauccugaaggagcaccccguggagaacacccagcugcagaacgagaagcuguaccuguacuaccugcagaacggcagagacauguacguggaccaggagcuggacaucaacagacugagcgacuacgacguggaccacaucgugccccagagcuuccugaaggacgacagcaucgacaacaaggugcugaccagaagcgacaagaacagaggcaagagcgacaacgugcccagcgaggagguggugaagaagaugaagaacuacuggagacagcugcugaacgccaagcugaucacccagagaaaguucgacaaccugaccaaggccgagagaggcggccugagcgagcuggacaaggccggcuucaucaagagacagcugguggagaccagacagaucaccaagcacguggcccagauccuggacagcagaaugaacaccaaguacgacgagaacgacaagcugaucagagaggugaaggugaucacccugaagagcaagcuggugagcgacuucagaaaggacuuccaguucuacaaggugagagagaucaacaacuaccaccacgcccacgacgccuaccugaacgccguggugggcaccgcccugaucaagaaguaccccaagcuggagagcgaguucguguacggcgacuacaagguguacgacgugagaaagaugaucgccaagagcgagcaggagaucggcaaggccaccgccaaguacuucuucuacagcaacaucaugaacuucuucaagaccgagaucacccuggccaacggcgagaucagaaagagaccccugaucgagaccaacggcgagaccggcgagaucgugugggacaagggcagagacuucgccaccgugagaaaggugcugagcaugccccaggugaacaucgugaagaagaccgaggugcagaccggcggcuucagcaaggagagcauccugcccaagagaaacagcgacaagcugaucgccagaaagaaggacugggaccccaagaaguacggcggcuucgacagccccaccguggccuacagcgugcuggugguggccaagguggagaagggcaagagcaagaagcugaagagcgugaaggagcugcugggcaucaccaucauggagagaagcagcuucgagaagaaccccaucgacuuccuggaggccaagggcuacaaggaggugaagaaggaccugaucaucaagcugcccaaguacagccuguucgagcuggagaacggcagaaagagaaugcuggccagcgccggcgagcugcagaagggcaacgagcuggcccugcccagcaaguacgugaacuuccuguaccuggccagccacuacgagaagcugaagggcagccccgaggacaacgagcagaagcagcuguucguggagcagcacaagcacuaccuggacgagaucaucgagcagaucagcgaguucagcaagagagugauccuggccgacgccaaccuggacaaggugcugagcgccuacaacaagcacagagacaagcccaucagagagcaggccgagaacaucauccaccuguucacccugaccaaccugggcgcccccgccgccuucaaguacuucgacaccaccaucgacagaaagagauacaccagcaccaaggaggugcuggacgccacccugauccaccagagcaucaccggccuguacgagaccagaaucgaccugagccagcugggcggcgacggcggcggcagccccaagaagaagagaaaggugugacuagcaccagccucaagaacacccgaauggagucucuaagcuacauaauaccaacuuacacuuuacaaaauguugucccccaaaauguagccauucguaucugcuccuaauaaaaagaaaguuucuucacauucucucgagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 177 - RNA, 4423 nt, Artificial Sequence
  Synthetic: mRNA transcript with XBG UTRs and Cas9 ORF with low A codons of Table 4
gggaagcucagaauaaacgcucaacuuuggccggaucugccaccauggacaagaaguacuccaucggccuggacaucggcaccaacuccgugggcugggccgugaucaccgacgaguacaaggugcccuccaagaaguucaaggugcugggcaacaccgaccggcacuccaucaagaagaaccugaucggcgcccugcuguucgacuccggcgagaccgccgaggccacccggcugaagcggaccgcccggcggcgguacacccggcggaagaaccggaucugcuaccugcaggagaucuucuccaacgagauggccaagguggacgacuccuucuuccaccggcuggaggaguccuuccugguggaggaggacaagaagcacgagcggcaccccaucuucggcaacaucguggacgagguggccuaccacgagaaguaccccaccaucuaccaccugcggaagaagcugguggacuccaccgacaaggccgaccugcggcugaucuaccuggcccuggcccacaugaucaaguuccggggccacuuccugaucgagggcgaccugaaccccgacaacuccgacguggacaagcuguucauccagcuggugcagaccuacaaccagcuguucgaggagaaccccaucaacgccuccggcguggacgccaaggccauccuguccgcccggcuguccaagucccggcggcuggagaaccugaucgcccagcugcccggcgagaagaagaacggccuguucggcaaccugaucgcccugucccugggccugacccccaacuucaaguccaacuucgaccuggccgaggacgccaagcugcagcuguccaaggacaccuacgacgacgaccuggacaaccugcuggcccagaucggcgaccaguacgccgaccuguuccuggccgccaagaaccuguccgacgccauccugcuguccgacauccugcgggugaacaccgagaucaccaaggccccccuguccgccuccaugaucaagcgguacgacgagcaccaccaggaccugacccugcugaaggcccuggugcggcagcagcugcccgagaaguacaaggagaucuucuucgaccaguccaagaacggcuacgccggcuacaucgacggcggcgccucccaggaggaguucuacaaguucaucaagcccauccuggagaagauggacggcaccgaggagcugcuggugaagcugaaccgggaggaccugcugcggaagcagcggaccuucgacaacggcuccaucccccaccagauccaccugggcgagcugcacgccauccugcggcggcaggaggacuucuaccccuuccugaaggacaaccgggagaagaucgagaagauccugaccuuccggauccccuacuacgugggcccccuggcccggggcaacucccgguucgccuggaugacccggaaguccgaggagaccaucacccccuggaacuucgaggaggugguggacaagggcgccuccgcccaguccuucaucgagcggaugaccaacuucgacaagaaccugcccaacgagaaggugcugcccaagcacucccugcuguacgaguacuucaccguguacaacgagcugaccaaggugaaguacgugaccgagggcaugcggaagcccgccuuccuguccggcgagcagaagaaggccaucguggaccugcuguucaagaccaaccggaaggugaccgugaagcagcugaaggaggacuacuucaagaagaucgagugcuucgacuccguggagaucuccggcguggaggaccgguucaacgccucccugggcaccuaccacgaccugcugaagaucaucaaggacaaggacuuccuggacaacgaggagaacgaggacauccuggaggacaucgugcugacccugacccuguucgaggaccgggagaugaucgaggagcggcugaagaccuacgcccaccuguucgacgacaaggugaugaagcagcugaagcggcggcgguacaccggcuggggccggcugucccggaagcugaucaacggcauccgggacaagcaguccggcaagaccauccuggacuuccugaaguccgacggcuucgccaaccggaacuucaugcagcugauccacgacgacucccugaccuucaaggaggacauccagaaggcccagguguccggccagggcgacucccugcacgagcacaucgccaaccuggccggcucccccgccaucaagaagggcauccugcagaccgugaaggugguggacgagcuggugaaggugaugggccggcacaagcccgagaacaucgugaucgagauggcccgggagaaccagaccacccagaagggccagaagaacucccgggagcggaugaagcggaucgaggagggcaucaaggagcugggcucccagauccugaaggagcaccccguggagaacacccagcugcagaacgagaagcuguaccuguacuaccugcagaacggccgggacauguacguggaccaggagcuggacaucaaccggcuguccgacuacgacguggaccacaucgugccccaguccuuccugaaggacgacuccaucgacaacaaggugcugacccgguccgacaagaaccggggcaaguccgacaacgugcccuccgaggagguggugaagaagaugaagaacuacuggcggcagcugcugaacgccaagcugaucacccagcggaaguucgacaaccugaccaaggccgagcggggcggccuguccgagcuggacaaggccggcuucaucaagcggcagcugguggagacccggcagaucaccaagcacguggcccagauccuggacucccggaugaacaccaaguacgacgagaacgacaagcugauccgggaggugaaggugaucacccugaaguccaagcugguguccgacuuccggaaggacuuccaguucuacaaggugcgggagaucaacaacuaccaccacgcccacgacgccuaccugaacgccguggugggcaccgcccugaucaagaaguaccccaagcuggaguccgaguucguguacggcgacuacaagguguacgacgugcggaagaugaucgccaaguccgagcaggagaucggcaaggccaccgccaaguacuucuucuacuccaacaucaugaacuucuucaagaccgagaucacccuggccaacggcgagauccggaagcggccccugaucgagaccaacggcgagaccggcgagaucgugugggacaagggccgggacuucgccaccgugcggaaggugcuguccaugccccaggugaacaucgugaagaagaccgaggugcagaccggcggcuucuccaaggaguccauccugcccaagcggaacuccgacaagcugaucgcccggaagaaggacugggaccccaagaaguacggcggcuucgacucccccaccguggccuacuccgugcuggugguggccaagguggagaagggcaaguccaagaagcugaaguccgugaaggagcugcugggcaucaccaucauggagcgguccuccuucgagaagaaccccaucgacuuccuggaggccaagggcuacaaggaggugaagaaggaccugaucaucaagcugcccaaguacucccuguucgagcuggagaacggccggaagcggaugcuggccuccgccggcgagcugcagaagggcaacgagcuggcccugcccuccaaguacgugaacuuccuguaccuggccucccacuacgagaagcugaagggcucccccgaggacaacgagcagaagcagcuguucguggagcagcacaagcacuaccuggacgagaucaucgagcagaucuccgaguucuccaagcgggugauccuggccgacgccaaccuggacaaggugcuguccgccuacaacaagcaccgggacaagcccauccgggagcaggccgagaacaucauccaccuguucacccugaccaaccugggcgcccccgccgccuucaaguacuucgacaccaccaucgaccggaagcgguacaccuccaccaaggaggugcuggacgccacccugauccaccaguccaucaccggccuguacgagacccggaucgaccugucccagcugggcggcgacggcggcggcucccccaagaagaagcggaaggugugacuagcaccagccucaagaacacccgaauggagucucuaagcuacauaauaccaacuuacacuuuacaaaauguugucccccaaaauguagccauucguaucugcuccuaauaaaaagaaaguuucuucacauucucucgagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 178 - RNA, 4421 nt, Artificial Sequence
  Synthetic: mRNA transcript with XBG UTRs and Cas9 ORF with low U/A codons of Table 4
gggaagcucagaauaaacgcucaacuuuggccggaucugccaccauggacaagaaguacagcaucggccuggacaucggcaccaacagcgugggcugggccgugaucaccgacgaguacaaggugcccagcaagaaguucaaggugcugggcaacaccgaccggcacagcaucaagaagaaccugaucggcgcccugcuguucgacagcggcgagaccgccgaggccacccggcugaagcggaccgcccggcggcgguacacccggcggaagaaccggaucugcuaccugcaggagaucuucagcaacgagauggccaagguggacgacagcuucuuccaccggcuggaggagagcuuccugguggaggaggacaagaagcacgagcggcaccccaucuucggcaacaucguggacgagguggccuaccacgagaaguaccccaccaucuaccaccugcggaagaagcugguggacagcaccgacaaggccgaccugcggcugaucuaccuggcccuggcccacaugaucaaguuccggggccacuuccugaucgagggcgaccugaaccccgacaacagcgacguggacaagcuguucauccagcuggugcagaccuacaaccagcuguucgaggagaaccccaucaacgccagcggcguggacgccaaggccauccugagcgcccggcugagcaagagccggcggcuggagaaccugaucgcccagcugcccggcgagaagaagaacggccuguucggcaaccugaucgcccugagccugggccugacccccaacuucaagagcaacuucgaccuggccgaggacgccaagcugcagcugagcaaggacaccuacgacgacgaccuggacaaccugcuggcccagaucggcgaccaguacgccgaccuguuccuggccgccaagaaccugagcgacgccauccugcugagcgacauccugcgggugaacaccgagaucaccaaggccccccugagcgccagcaugaucaagcgguacgacgagcaccaccaggaccugacccugcugaaggcccuggugcggcagcagcugcccgagaaguacaaggagaucuucuucgaccagagcaagaacggcuacgccggcuacaucgacggcggcgccagccaggaggaguucuacaaguucaucaagcccauccuggagaagauggacggcaccgaggagcugcuggugaagcugaaccgggaggaccugcugcggaagcagcggaccuucgacaacggcagcaucccccaccagauccaccugggcgagcugcacgccauccugcggcggcaggaggacuucuaccccuuccugaaggacaaccgggagaagaucgagaagauccugaccuuccggauccccuacuacgugggcccccuggcccggggcaacagccgguucgccuggaugacccggaagagcgaggagaccaucacccccuggaacuucgaggaggugguggacaagggcgccagcgcccagagcuucaucgagcggaugaccaacuucgacaagaaccugcccaacgagaaggugcugcccaagcacagccugcuguacgaguacuucaccguguacaacgagcugaccaaggugaaguacgugaccgagggcaugcggaagcccgccuuccugagcggcgagcagaagaaggccaucguggaccugcuguucaagaccaaccggaaggugaccgugaagcagcugaaggaggacuacuucaagaagaucgagugcuucgacagcguggagaucagcggcguggaggaccgguucaacgccagccugggcaccuaccacgaccugcugaagaucaucaaggacaaggacuuccuggacaacgaggagaacgaggacauccuggaggacaucgugcugacccugacccuguucgaggaccgggagaugaucgaggagcggcugaagaccuacgcccaccuguucgacgacaaggugaugaagcagcugaagcggcggcgguacaccggcuggggccggcugagccggaagcugaucaacggcauccgggacaagcagagcggcaagaccauccuggacuuccugaagagcgacggcuucgccaaccggaacuucaugcagcugauccacgacgacagccugaccuucaaggaggacauccagaaggcccaggugagcggccagggcgacagccugcacgagcacaucgccaaccuggccggcagccccgccaucaagaagggcauccugcagaccgugaaggugguggacgagcuggugaaggugaugggccggcacaagcccgagaacaucgugaucgagauggcccgggagaaccagaccacccagaagggccagaagaacagccgggagcggaugaagcggaucgaggagggcaucaaggagcugggcagccagauccugaaggagcaccccguggagaacacccagcugcagaacgagaagcuguaccuguacuaccugcagaacggccgggacauguacguggaccaggagcuggacaucaaccggcugagcgacuacgacguggaccacaucgugccccagagcuuccugaaggacgacagcaucgacaacaaggugcugacccggagcgacaagaaccggggcaagagcgacaacgugcccagcgaggagguggugaagaagaugaagaacuacuggcggcagcugcugaacgccaagcugaucacccagcggaaguucgacaaccugaccaaggccgagcggggcggccugagcgagcuggacaaggccggcuucaucaagcggcagcugguggagacccggcagaucaccaagcacguggcccagauccuggacagccggaugaacaccaaguacgacgagaacgacaagcugauccgggaggugaaggugaucacccugaagagcaagcuggugagcgacuuccggaaggacuuccaguucuacaaggugcgggagaucaacaacuaccaccacgcccacgacgccuaccugaacgccguggugggcaccgcccugaucaagaaguaccccaagcuggagagcgaguucguguacggcgacuacaagguguacgacgugcggaagaugaucgccaagagcgagcaggagaucggcaaggccaccgccaaguacuucuucuacagcaacaucaugaacuucuucaagaccgagaucacccuggccaacggcgagauccggaagcggccccugaucgagaccaacggcgagaccggcgagaucgugugggacaagggccgggacuucgccaccgugcggaaggugcugagcaugccccaggugaacaucgugaagaagaccgaggugcagaccggcggcuucagcaaggagagcauccugcccaagcggaacagcgacaagcugaucgcccggaagaaggacugggaccccaagaaguacggcggcuucgacagccccaccguggccuacagcgugcuggugguggccaagguggagaagggcaagagcaagaagcugaagagcgugaaggagcugcugggcaucaccaucauggagcggagcagcuucgagaagaaccccaucgacuuccuggaggccaagggcuacaaggaggugaagaaggaccugaucaucaagcugcccaaguacagccuguucgagcuggagaacggccggaagcggaugcuggccagcgccggcgagcugcagaagggcaacgagcuggcccugcccagcaaguacgugaacuuccuguaccuggccagccacuacgagaagcugaagggcagccccgaggacaacgagcagaagcagcuguucguggagcagcacaagcacuaccuggacgagaucaucgagcagaucagcgaguucagcaagcgggugauccuggccgacgccaaccuggacaaggugcugagcgccuacaacaagcaccgggacaagcccauccgggagcaggccgagaacaucauccaccuguucacccugaccaaccugggcgcccccgccgccuucaaguacuucgacaccaccaucgaccggaagcgguacaccagcaccaaggaggugcuggacgccacccugauccaccagagcaucaccggccuguacgagacccggaucgaccugagccagcugggcggcgacggcggcggcagccccaagaagaagcggaaggugugacuagcaccagccucaagaacacccgaauggagucucuaagcuacauaauaccaacuuacacuuuacaaaauguugucccccaaaauguagccauucguaucugcuccuaauaaaaagaaaguuucuucacauucucucgagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaucuag

SEQ ID NO: 179 - DNA, 4564 bp, Artificial Sequence
  Synthetic: mRNA transcript with ORF encoding Cas9 with HiBiT tag, HSD 5 UTR and human ALB 3 UTR
gggtcccgcagtcggcgtccagcggctctgcttgttcgtgtgtgtgtcgttgcaggccttattcggatccgccaccatggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcccgaagaagaagagaaaggtcagcgaaagcgcaacaccggaaagcgtcagcggatggagactgttcaagaagatcagctagctagccatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctcgagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 180 - DNA, 4544 bp, Artificial Sequence
  Synthetic: mRNA transcript with ORF encoding Cas9 with HiBiT tag, CMV-1 5 UTR and human ALB 3 UTR
gggcagatcgcctggagacgccatccacgctgttttgacctccatcgccaccatggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcccgaagaagaagagaaaggtcagcgaaagcgcaacaccggaaagcgtcagcggatggagactgttcaagaagatcagctagctagccatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctcgagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 181 - DNA, 4544 bp, Artificial Sequence
  Synthetic: mRNA transcript with ORF encoding Cas9 with HiBiT tag, CMV-2 5 UTR and human ALB 3 UTR
gggagaagacaccgggaccgatccagcctccgcggccgggaacggcgccaccatggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcccgaagaagaagagaaaggtcagcgaaagcgcaacaccggaaagcgtcagcggatggagactgttcaagaagatcagctagctagccatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctcgagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 182 - DNA, 4544 bp, Artificial Sequence
  Synthetic: mRNA transcript with ORF encoding Cas9 with HiBiT tag, CMV-3 5 UTR and human ALB 3 UTR
gggtgcattggaacgcggattccccgtgccaagagtgactcaccgcgccaccatggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcccgaagaagaagagaaaggtcagcgaaagcgcaacaccggaaagcgtcagcggatggagactgttcaagaagatcagctagctagccatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctcgagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 183 - DNA, 4568 bp, Artificial Sequence
  Synthetic: mRNA transcript with ORF encoding Cas9 with HiBiT tag, HBA 5 UTR and human ALB 3 UTR
gggcataaaccctggcgcgctcgcggcccggcactcttctggtccccacagactcagagagaacccacccgccaccatggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcccgaagaagaagagaaaggtcagcgaaagcgcaacaccggaaagcgtcagcggatggagactgttcaagaagatcagctagctagccatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctcgagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 184 - DNA, 4558 bp, Artificial Sequence
  Synthetic: mRNA transcript with ORF encoding Cas9 with HiBiT tag, HBB 5 UTR and human ALB 3 UTR
gggacatttgcttctgacacaactgtgttcactagcaacctcaaacagacaccggatctcgccaccatggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcccgaagaagaagagaaaggtcagcgaaagcgcaacaccggaaagcgtcagcggatggagactgttcaagaagatcagctagctagccatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctcgagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 185 - DNA, 4537 bp, Artificial Sequence
  Synthetic: mRNA transcript with ORF encoding Cas9 with HiBiT tag, XBG 5 UTR and human ALB 3 UTR
gggaagctcagaataaacgctcaactttggccggatctcgccaccatggacaagaagtacagcatcggactggacatcggaacaaacagcgtcggatgggcagtcatcacagacgaatacaaggtcccgagcaagaagttcaaggtcctgggaaacacagacagacacagcatcaagaagaacctgatcggagcactgctgttcgacagcggagaaacagcagaagcaacaagactgaagagaacagcaagaagaagatacacaagaagaaagaacagaatctgctacctgcaggaaatcttcagcaacgaaatggcaaaggtcgacgacagcttcttccacagactggaagaaagcttcctggtcgaagaagacaagaagcacgaaagacacccgatcttcggaaacatcgtcgacgaagtcgcataccacgaaaagtacccgacaatctaccacctgagaaagaagctggtcgacagcacagacaaggcagacctgagactgatctacctggcactggcacacatgatcaagttcagaggacacttcctgatcgaaggagacctgaacccggacaacagcgacgtcgacaagctgttcatccagctggtccagacatacaaccagctgttcgaagaaaacccgatcaacgcaagcggagtcgacgcaaaggcaatcctgagcgcaagactgagcaagagcagaagactggaaaacctgatcgcacagctgccgggagaaaagaagaacggactgttcggaaacctgatcgcactgagcctgggactgacaccgaacttcaagagcaacttcgacctggcagaagacgcaaagctgcagctgagcaaggacacatacgacgacgacctggacaacctgctggcacagatcggagaccagtacgcagacctgttcctggcagcaaagaacctgagcgacgcaatcctgctgagcgacatcctgagagtcaacacagaaatcacaaaggcaccgctgagcgcaagcatgatcaagagatacgacgaacaccaccaggacctgacactgctgaaggcactggtcagacagcagctgccggaaaagtacaaggaaatcttcttcgaccagagcaagaacggatacgcaggatacatcgacggaggagcaagccaggaagaattctacaagttcatcaagccgatcctggaaaagatggacggaacagaagaactgctggtcaagctgaacagagaagacctgctgagaaagcagagaacattcgacaacggaagcatcccgcaccagatccacctgggagaactgcacgcaatcctgagaagacaggaagacttctacccgttcctgaaggacaacagagaaaagatcgaaaagatcctgacattcagaatcccgtactacgtcggaccgctggcaagaggaaacagcagattcgcatggatgacaagaaagagcgaagaaacaatcacaccgtggaacttcgaagaagtcgtcgacaagggagcaagcgcacagagcttcatcgaaagaatgacaaacttcgacaagaacctgccgaacgaaaaggtcctgccgaagcacagcctgctgtacgaatacttcacagtctacaacgaactgacaaaggtcaagtacgtcacagaaggaatgagaaagccggcattcctgagcggagaacagaagaaggcaatcgtcgacctgctgttcaagacaaacagaaaggtcacagtcaagcagctgaaggaagactacttcaagaagatcgaatgcttcgacagcgtcgaaatcagcggagtcgaagacagattcaacgcaagcctgggaacataccacgacctgctgaagatcatcaaggacaaggacttcctggacaacgaagaaaacgaagacatcctggaagacatcgtcctgacactgacactgttcgaagacagagaaatgatcgaagaaagactgaagacatacgcacacctgttcgacgacaaggtcatgaagcagctgaagagaagaagatacacaggatggggaagactgagcagaaagctgatcaacggaatcagagacaagcagagcggaaagacaatcctggacttcctgaagagcgacggattcgcaaacagaaacttcatgcagctgatccacgacgacagcctgacattcaaggaagacatccagaaggcacaggtcagcggacagggagacagcctgcacgaacacatcgcaaacctggcaggaagcccggcaatcaagaagggaatcctgcagacagtcaaggtcgtcgacgaactggtcaaggtcatgggaagacacaagccggaaaacatcgtcatcgaaatggcaagagaaaaccagacaacacagaagggacagaagaacagcagagaaagaatgaagagaatcgaagaaggaatcaaggaactgggaagccagatcctgaaggaacacccggtcgaaaacacacagctgcagaacgaaaagctgtacctgtactacctgcagaacggaagagacatgtacgtcgaccaggaactggacatcaacagactgagcgactacgacgtcgaccacatcgtcccgcagagcttcctgaaggacgacagcatcgacaacaaggtcctgacaagaagcgacaagaacagaggaaagagcgacaacgtcccgagcgaagaagtcgtcaagaagatgaagaactactggagacagctgctgaacgcaaagctgatcacacagagaaagttcgacaacctgacaaaggcagagagaggaggactgagcgaactggacaaggcaggattcatcaagagacagctggtcgaaacaagacagatcacaaagcacgtcgcacagatcctggacagcagaatgaacacaaagtacgacgaaaacgacaagctgatcagagaagtcaaggtcatcacactgaagagcaagctggtcagcgacttcagaaaggacttccagttctacaaggtcagagaaatcaacaactaccaccacgcacacgacgcatacctgaacgcagtcgtcggaacagcactgatcaagaagtacccgaagctggaaagcgaattcgtctacggagactacaaggtctacgacgtcagaaagatgatcgcaaagagcgaacaggaaatcggaaaggcaacagcaaagtacttcttctacagcaacatcatgaacttcttcaagacagaaatcacactggcaaacggagaaatcagaaagagaccgctgatcgaaacaaacggagaaacaggagaaatcgtctgggacaagggaagagacttcgcaacagtcagaaaggtcctgagcatgccgcaggtcaacatcgtcaagaagacagaagtccagacaggaggattcagcaaggaaagcatcctgccgaagagaaacagcgacaagctgatcgcaagaaagaaggactgggacccgaagaagtacggaggattcgacagcccgacagtcgcatacagcgtcctggtcgtcgcaaaggtcgaaaagggaaagagcaagaagctgaagagcgtcaaggaactgctgggaatcacaatcatggaaagaagcagcttcgaaaagaacccgatcgacttcctggaagcaaagggatacaaggaagtcaagaaggacctgatcatcaagctgccgaagtacagcctgttcgaactggaaaacggaagaaagagaatgctggcaagcgcaggagaactgcagaagggaaacgaactggcactgccgagcaagtacgtcaacttcctgtacctggcaagccactacgaaaagctgaagggaagcccggaagacaacgaacagaagcagctgttcgtcgaacagcacaagcactacctggacgaaatcatcgaacagatcagcgaattcagcaagagagtcatcctggcagacgcaaacctggacaaggtcctgagcgcatacaacaagcacagagacaagccgatcagagaacaggcagaaaacatcatccacctgttcacactgacaaacctgggagcaccggcagcattcaagtacttcgacacaacaatcgacagaaagagatacacaagcacaaaggaagtcctggacgcaacactgatccaccagagcatcacaggactgtacgaaacaagaatcgacctgagccagctgggaggagacggaggaggaagcccgaagaagaagagaaaggtcagcgaaagcgcaacaccggaaagcgtcagcggatggagactgttcaagaagatcagctagctagccatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctcgagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 186 - protein, 1381 aa, Artificial Sequence
  Synthetic: Amino acid sequence for Cas9 with NLS1
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSLAAKRSRTT

SEQ ID NO: 187 - protein, 1381 aa, Artificial Sequence
  Synthetic: Amino acid sequence for Cas9 with NLS2
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSQAAKRSRTT

SEQ ID NO: 188 - protein, 1382 aa, Artificial Sequence
  Synthetic: Amino acid sequence for Cas9 with NLS3
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSPAPAKRERTT

SEQ ID NO: 189 - protein, 1381 aa, Artificial Sequence
  Synthetic: Amino acid sequence for Cas9 with NLS4
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSQAAKRPRTT

SEQ ID NO: 190 - protein, 1381 aa, Artificial Sequence
  Synthetic: Amino acid sequence for Cas9 with NLS5
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSRAAKRPRTT

SEQ ID NO: 191 - protein, 1383 aa, Artificial Sequence
  Synthetic: Amino acid sequence for Cas9 with NLS6
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAAAKRSWSMAA

SEQ ID NO: 192 - protein, 1383 aa, Artificial Sequence
  Synthetic: Amino acid sequence for Cas9 with NLS7
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAAAKRVWSMAF

SEQ ID NO: 193 - protein, 1383 aa, Artificial Sequence
  Synthetic: Amino acid sequence for Cas9 with NLS8
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAAAKRSWSMAF

SEQ ID NO: 194 - protein, 1382 aa, Artificial Sequence
  Synthetic: Amino acid sequence for Cas9 with NLS9
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSAAAKRKYFAA

SEQ ID NO: 195 - protein, 1382 aa, Artificial Sequence
  Synthetic: Amino acid sequence for Cas9 with NLS10
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSRAAKRKAFAA

SEQ ID NO: 196 - protein, 1382 aa, Artificial Sequence
  Synthetic: Amino acid sequence for Cas9 with NLS11
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDGGGSRAAKRKYFAV

SEQ ID NO: 197 - RNA, 100 nt, Artificial Sequence
  Synthetic: G506 guide RNA
  modified_base (1)..(3): PS linkage, 2'-O-Me nucleotide
  modified_base (29)..(40): 2'-O-Me nucleotide
  modified_base (69)..(97): 2'-O-Me nucleotide
  modified_base (97)..(100): PS linkage, 2'-O-Me nucleotide
auaccaguccagcgaggcagguuuuagagcuagaaauagcaaguuaaaauaaggcuaguccguuaucaacuugaaaaaguggcaccgagucggugcuuuu

SEQ ID NO: 198 - RNA, 100 nt, Artificial Sequence
  Synthetic: G510 guide RNA
  modified_base (1)..(3): PS linkage, 2'-O-Me nucleotide
  modified_base (29)..(40): 2'-O-Me nucleotide
  modified_base (69)..(96): 2'-O-Me nucleotide
  modified_base (97)..(100): PS linkage, 2'-O-Me nucleotide
acuugucuucucuauacccaguuuuagagcuagaaauagcaaguuaaaauaaggcuaguccguuaucaacuugaaaaaguggcaccgagucggugcuuuu

We claim:

1. An mRNA comprising an open reading frame encoding an RNA-guided DNA-binding agent, wherein the open reading frame has an adenine content ranging from its minimum adenine content to 105% of the minimum adenine content, wherein the mRNA comprises a sequence with at least 98% identity to SEQ ID NO: 111, 114, or 117.

2. The mRNA of claim 1, wherein the open reading frame has an adenine content ranging from its minimum adenine content to 101%, 102%, 103%, or 104% of the minimum adenine content.

3. The mRNA of claim 1, wherein the mRNA comprises a sequence of any one of SEQ ID NOs: 111, 114, or 117.

4. The mRNA of claim 1, wherein the RNA-guided DNA-binding agent has double-stranded endonuclease activity or nickase activity.

5. The mRNA of claim 1, wherein the RNA-guided DNA-binding agent comprises a dCas DNA binding domain.

6. The mRNA of claim 1, wherein the mRNA encodes a polypeptide comprising the amino acid sequence of SEQ ID NO: 3, 6, 8, or 186-196.

7. The mRNA of claim 1, wherein the mRNA further comprises a 5' UTR with at least 90% identity to any one of SEQ ID NOs: 32, 34, 36, 38, 41, or 75-77.

8. The mRNA of claim 1, wherein the mRNA further comprises a 3' UTR with at least 90% identity to any one of SEQ ID NOs: 33, 35, 37, 39, or 40.

9. The mRNA of claim 1, which comprises a 5' cap selected from Cap0, Cap1, and Cap2.

10. The mRNA of claim 1, wherein the RNA-guided DNA-binding agent further comprises a heterologous functional domain.

11. The mRNA of claim 10, wherein the heterologous functional domain is a FokI nuclease or a transcriptional regulatory domain.

12. The mRNA of claim 1, wherein at least 10% of the uridine is substituted with a modified uridine, wherein the modified uridine is one or more of N1-methyl-pseudouridine, pseudouridine, 5-methoxyuridine, or 5-iodouridine.

13. The mRNA of claim 1, wherein the mRNA comprises a sequence with 100% identity to SEQ ID NO: 177.

14. An mRNA comprising a sequence with at least 98% identical to SEQ ID NO: 111.

15. An mRNA comprising a sequence with at least 98% identity to SEQ ID NO: 111, 114, or 117, and any one or more of the following:
   a. a 5' cap selected from Cap0, Cap 1, and Cap2;
   b. a 5' UTR with at least 90% identity to any one of SEQ ID NOs: 32, 34, 36, 38, 41, or 75-77; and
   c. a 3' UTR with at least 90% identity to any one of SEQ ID NOs: 33, 35, 37, 39, or 40.

16. The mRNA of claim 15, wherein at least 10% of the uridine is substituted with a modified uridine, wherein the modified uridine is one or more of N1-methyl-pseudouridine, pseudouridine, 5-methoxyuridine, or 5-iodouridine.

17. An expression construct comprising a promoter operably linked to a sequence encoding an mRNA according to claim 14, wherein the expression construct is optionally a plasmid expression construct.

18. An isolated host cell comprising the expression construct of claim 17.

19. A method of preparing an mRNA comprising contacting the expression construct of claim 17 with an RNA polymerase under conditions permissive for transcription of the mRNA.

20. A composition comprising the mRNA according to claim 14 and at least one guide RNA.

21. The composition of claim 20, wherein the at least one guide RNA targets the TTR gene of a mammal.

22. A lipid nanoparticle comprising the mRNA according to claim 14.

23. A pharmaceutical composition comprising the mRNA according to claim 14 and a pharmaceutically acceptable carrier.

24. A method of genome editing or modifying a target gene comprising contacting a cell with the mRNA according to claim 14.

25. The method of claim 24, wherein the genome editing or modification of the new target gene occurs in a liver cell.

26. An mRNA comprising a sequence identical to SEQ ID NO: 111.

* * * * *